(12) United States Patent
Rome et al.

(10) Patent No.: US 7,482,319 B2
(45) Date of Patent: Jan. 27, 2009

(54) VAULT AND VAULT-LIKE CARRIER MOLECULES

(75) Inventors: Leonard H. Rome, Tarzana, CA (US); Valerie A. Kickhoefer, Sherman Oaks, CA (US); Sujna Raval-Fernandes, West Hills, CA (US); Phoebe L. Stewart, Brentwood, TN (US)

(73) Assignee: The Regents of the University of California, Oakland, CA (US)

( * ) Notice: Subject to any disclaimer, the term of this patent is extended or adjusted under 35 U.S.C. 154(b) by 292 days.

(21) Appl. No.: 10/547,530

(22) PCT Filed: Mar. 10, 2004

(86) PCT No.: PCT/US2004/007434

§ 371 (c)(1),
(2), (4) Date: Aug. 31, 2005

(87) PCT Pub. No.: WO2004/081533

PCT Pub. Date: Sep. 23, 2004

(65) Prior Publication Data

US 2006/0148086 A1     Jul. 6, 2006

Related U.S. Application Data

(60) Provisional application No. 60/453,800, filed on Mar. 10, 2003.

(51) Int. Cl.
| | | |
|---|---|---|
| C12N 11/00 | (2006.01) | |
| C12N 11/02 | (2006.01) | |
| C12N 11/06 | (2006.01) | |
| C12N 15/87 | (2006.01) | |
| C12N 15/88 | (2006.01) | |
| A61K 31/7088 | (2006.01) | |
| A61K 38/00 | (2006.01) | |
| C12Q 1/00 | (2006.01) | |

(52) U.S. Cl. .............................. 514/2; 514/44; 435/455; 435/459; 530/350

(58) Field of Classification Search ....................... None
See application file for complete search history.

(56) References Cited

OTHER PUBLICATIONS

Suprenant, Biochemistry, 2002, vol. 41, No. 49, pp. 14447-14454.*
vanZon et al., Biochem. Biophys. Res. Comm., 2002, vol. 291, No. 3, pp. 535-541.*
van Zon et al., Exp. Cell Res., 2006, vol. 312, pp. 245-255.*
Kong L.B. et al., "Structure of the vault, a ubiquitous cellular component," Structure, Apr. 1999, 7:371-379.
Supplementary European Search Report, issued Jan. 23, 2008 in corresponding European Patent Application No. 04719308.1-2107.

* cited by examiner

*Primary Examiner*—David Guzo
(74) *Attorney, Agent, or Firm*—Fenwick & West LLP

(57) ABSTRACT

A method of using vaults as carrier molecules to deliver one or more than one substance to an organism, or to a specific tissue or to specific cells, or to an environmental medium. A vault-like particle. A method of preventing damage by one or more than one substance to an organism, to a specific tissue, to specific cells, or to an environmental medium, by sequestering the one or more than one substance within a vault-like particle. A method of delivering one or more than one substance or a sensor to an organism, to a specific tissue, to specific cells, or to an environmental medium. According to another embodiment of the present invention, there is provided a method of making vault-like particles, and making vault-like particles comprising one or more than one substance, or one or more than one sensor.

4 Claims, No Drawings

VAULT AND VAULT-LIKE CARRIER MOLECULES

CROSS-REFERENCE TO RELATED APPLICATIONS

This application is a national phase filing of International Patent Application No. PCT/US04/07434 titled "Vault and Vault-Like Carrier Molecules," filed Mar. 10, 2004 which claims the benefit of U.S. Provisional Patent Application No. 60/453,800 titled "Vault Nano Capsules" filed Mar. 10, 2003, the contents of which are incorporated in this disclosure by reference in their entirety.

STATEMENT REGARDING FEDERALLY SPONSORED RESEARCH OR DEVELOPMENT

This invention was made with United States Government support under National Science Foundation, Nano Science Interdisciplinary Research Team Grant No. MCB-0210690 National Science Foundation Grant No. MCB-9722353. The United States Government has certain rights in this invention.

BACKGROUND

Vaults are ubiquitous, highly conserved cellular components found in phylogeny as diverse as mammals, avians, amphibians, the slime mold *Dictyostelium discoideum*, and the protozoan *Trypanosoma brucei*. Scanning transmission electron microscopic analysis has shown that the molecular mass of vaults is about 12.9±1 MDa, and cryo-electronmicrograph single particle reconstruction has determined that vaults have an overall dimension of about 420×420×750 Å. Thus, vaults have a greater mass and size than many icosahedral viruses. The function of vaults is currently unknown.

Vaults are ribonucleoprotein particles comprising three different proteins, designated MVP, VPARP and TEP1, and between one and three different untranslated RNA molecules, designated vRNAs. For example, the rat *Rattus norvegicus* has only one form of vRNA per vault, while humans have three forms of vRNA per vault. The major vault protein, MVP, a 95.8 kDa protein in *Rattus norvegicus* and a 99.3 kDa protein in humans, is present in 96 copies per vault and accounts for about 75% of the total protein mass of the vault particle. The two other proteins, the vault poly-ADP ribose polymerase, VPARP, a 193.3 kDa protein in humans, and the telomerase/vault associated protein 1, TEP1, a 292 kDa protein in *Rattus norvegicus* and a 290 kDa protein in humans, are each present in between about 2 and 16 copies per vault.

VPARP, is a poly ADP-ribosyl polymerase apparently unique to vaults. It includes a region of about 350 amino acids that shares 28% identity with the catalytic domain of poly ADP-ribosyl polymerase, PARP, a nuclear protein that catalyzes the formation of ADP-ribose polymers in response to DNA damage. VPARP catalyzes an NAD-dependent poly ADP-ribosylation reaction, and purified vaults have poly ADP-ribosylation activity that targets MVP, as well as VPARP itself.

Cryo-electron microscopy studies have determined that the vaults are hollow, barrel-like structures with two protruding end caps and an invaginated waist. Regular small openings surround the vault cap. These openings are large enough to allow small molecules and ions to enter the interior of the vault. The volume of the internal cavity of the vault is about $5 \times 10^7$ Å$^3$, large enough to enclose two ribosomes.

SUMMARY

According to one embodiment of the present invention, there is provided a method of using vaults as carrier molecules to deliver one or more than one substance to an organism, or to a specific tissue or to specific cells, or to an environmental medium. The method comprises providing vaults, incorporating the one or more than one substance into the vaults, and administering the vaults comprising the one or more than one substance to the organism, to the specific tissue, to the specific cells, or to the environmental medium. In one embodiment, the vaults provided are purified from natural sources. In another embodiment, the vaults provided are generated using recombinant technology. In one embodiment, incorporation is accomplished by incubating the vaults with the one or more than one substance. In one embodiment, the one or more than one substance is selected from the group consisting of an enzyme, a pharmaceutical agent, a plasmid, a polynucleotide, a polypeptide, a sensor and a combination of the preceding.

According to another embodiment of the present invention, there is provided a vault-like particle comprising MVP. In one embodiment, the vault-like particle further comprises VPARP or modified VPARP, or a portion of VPARP or a modified portion of VPARP. In another embodiment, the vault-like further comprises TEP1 or modified TEP1, or a portion of TEP1 or a modified portion of TEP1.

According to another embodiment of the present invention, there is provided a vault-like particle comprising modified MVP. In one embodiment, the modified MVP comprises an amino acid sequence added to the N-terminal of the MVP which results in one or more than one substance-binding domain within the vault-like particle. In another embodiment, the one or more than one substance-binding domain is between 1 and 95 substance-binding domains. In another embodiment, the one or more than one substance-binding domain is 96 substance-binding domains. In another embodiment, the one or more than one substance-binding domain is greater than 96 substance-binding domains. In one embodiment, the one or more than one substance-binding domain within the vault-like particle is one or more than one heavy metal binding domain. In a preferred embodiment, the one or more than one heavy metal binding domain binds a heavy metal selected from the group consisting of cadmium, copper, gold and mercury. In a preferred embodiment, the peptide added to the N-terminal is a cysteine-rich peptide. In a preferred embodiment, the one or more than one substance-binding domain within the vault-like particle is one or more than one polynucleotide-binding domain. In a preferred embodiment, the one or more than one polynucleotide-binding domain is a non-specific polynucleotide-binding peptide. In a preferred embodiment, the one or more than one polynucleotide-binding domain is a specific polynucleotide-binding peptide.

In another embodiment, the modified MVP of the vault-like particle comprising modified MVP comprises an amino acid sequence added to the N-terminal of the MVP creates a sensor in the vault-like particle. In one embodiment, the sensor is selected from the group consisting of a chemical sensor, an ionic sensor, a microorganism sensor, an optical sensor and a pH sensor. In one embodiment, the sensor is a green fluorescent protein.

In another embodiment, the modified MVP of the vault-like particle comprising modified MVP comprises an amino acid sequence added to the C-terminal of the MVP which results in one or more than one receptor-binding domain. In one embodiment, the one or more than one receptor-binding domain is between 1 and 95 receptor-binding domains. In another embodiment, the one or more than one receptor-binding domain is 96 receptor-binding domains. In another embodiment, the one or more than one receptor-binding domain is greater than 96 receptor-binding domains. In one embodiment, the one or more than one receptor-binding domain is non-specific. In another embodiment, the one or more than one receptor-binding domain is specific.

In another embodiment, the modified MVP further comprises an amino acid sequence added to the C-terminal of the MVP which results in one or more than one receptor-binding domain. In one embodiment, the one or more than one receptor-binding domain is between 1 and 95 receptor-binding domains. In another embodiment, the one or more than one receptor-binding domain is 96 receptor-binding domains. In another embodiment, the one or more than one receptor-binding domain, is greater than 96 receptor-binding domains. In one embodiment, the one or more than one receptor-binding domain is non-specific. In another embodiment, the one or more than one receptor-binding domain is specific.

In another embodiment, the modified MVP comprises both an amino acid sequence added to the C-terminal of the MVP and an amino acid sequence added to the N-terminal of the MVP.

According to another embodiment of the present invention, there is provided a vault-like particle comprising MVP or modified MVP, and further comprises VPARP or a portion of VPARP comprising at least about 150 consecutive residues of VPARP. In one embodiment, the portion of VPARP comprises residues from about residue 1562 to 1724 of human VPARP, SEQ ID NO:3. In another embodiment, the portion of VPARP comprises residues from about residue 1473 to 1724 of human VPARP, SEQ ID NO:3. In another embodiment, the VPARP or portion of VPARP is modified. In one embodiment, the modification comprises adding an amino acid sequence added to the C-terminal of the VPARP or portion of VPARP. In another embodiment, the modification comprises adding an amino acid sequence added to the N-terminal of the VPARP or portion of VPARP. In another embodiment, the modification comprises adding an amino acid sequence added to both the C-terminal and the N-terminal of the VPARP or portion of VPARP. In one embodiment, the modified MVP comprises an amino acid sequence added to the C-terminal of the MVP. In another embodiment, the modified MVP comprises an amino acid sequence added to the N-terminal of the MVP. In another embodiment, the modified MVP comprises both a peptide added to the C-terminal and a peptide added to the N-terminal.

According to another embodiment of the present invention, there is provided a method of preventing damage by one or more than one substance to an organism, to a specific tissue, to specific cells, or to an environmental medium, by sequestering the one or more than one substance within a vault-like particle. The method comprises providing vault-like particles, administering the vault-like particles to the organism, tissue, cells or environmental medium, and allowing the vault-like particles to sequester the one or more than one substance within the vault-like particles. In one embodiment, the one or more than one substance is a heavy metal selected from the group consisting of cadmium, copper, gold and mercury. In another embodiment, the one or more than one substance is a toxin selected from the group consisting of arsenate, dioxin, an organochlorine, a pentachlorophenol and a polychlorinated biphenyl. In one embodiment, providing the vault-like particles comprises expressing the vault-like particles in a eukaryotic organism.

According to another embodiment of the present invention, there is provided a method of delivering one or more than one substance to an organism, to a specific tissue, to specific cells, or to an environmental medium. The method comprises providing vault-like particles comprising the one or more than one substance, and administering the vault-like particles comprising the one or more than one substance to the organism, tissue, cells or environmental medium. In one embodiment, the vault-like particles comprise, consist essentially of or consist of a modified MVP in addition to the one or more than one substance. In another embodiment, the vault-like particles comprise a modified VPARP or modified portion of VPARP. In another embodiment, the vault-like particles comprise both a modified MVP according to the present invention, and a modified VPARP or modified portion of VPARP. In another embodiment, the one or more than one substance is selected from the group consisting of an enzyme, a pharmaceutical agent, a plasmid, a polynucleotide, a polypeptide, a sensor and a combination of the preceding. In another embodiment, the one or more than one substance is adenosine deaminase.

According to another embodiment of the present invention, there is provided a method of delivering one or more than one sensor to an organism, to a specific tissue, to specific cells, or to an environmental medium. The method comprises providing a vault-like particle comprising the one or more than one sensor and administering the vault-like particle to the organism, specific tissue, specific cells, or environmental medium. In one embodiment, the vault-like particles comprise, consist essentially of or consist of a modified MVP, in addition to the one or more than one sensor; In another embodiment, the vault-like particles comprise a modified VPARP or modified portion of VPARP. In another embodiment, the vault-like particles comprise both a modified MVP, and a modified VPARP or modified portion of VPARP. In one embodiment, the sensor is selected from the group consisting of a chemical sensor, a fluorescent sensor, an ionic sensor, a microorganism sensor, an optical sensor, and a pH sensor.

According to another embodiment of the present invention, there is provided a method of detecting a signal from a sensor within an organism, or a specific tissue or specific cells. The method comprises delivering one or more than one sensor to an organism, to a specific tissue, to specific cells, or to an environmental medium according to the present invention, and detecting the presence of the sensor. In one embodiment, detection is accomplished by fluorometry or by spectrophotometry.

According to another embodiment of the present invention, there is provided a method of making vault-like particles. The method comprises creating polynucleotide sequences encoding one or more than one polypeptide selected from the group consisting of MVP, modified MVP, VPARP, a portion of VPARP, modified VPARP, a modified portion of VPARP, TEP1, a portion of TEP1, modified TEP1 and a modified portion of TEP1, using the polynucleotide sequences created to generate a bacmid DNA, using the bacmid DNA to generate a baculovirus comprising the sequence, and using the baculovirus to infect insect cells for protein production using an in situ assembly system.

According to another embodiment of the present invention, there is provided a method of making vault-like particles comprising one or more than one substance. The method comprises making vault-like particles according to claim 63, and co-incubated the vault-like particles with the one or more than one substance. In one embodiment, the one or more than one substance is selected from the group consisting of enzyme, a pharmaceutical agent, a plasmid, a polynucleotide, a polypeptide, a sensor and a combination of the preceding. In another embodiment, the method further comprises purifying the vault-like particles after making the vault-like particles.

DESCRIPTION

According to one embodiment of the present invention, there is provided a method of using vaults as carrier molecules to deliver one or more than one substance to an organism, or to a specific tissue or specific cells. The method comprises administering vaults comprising the substance to the organism, tissue or cells.

According to another embodiment of the present invention, there is provided a vault-like particle useful as a carrier molecule for delivering one or more than one substance to a living system, such as an organism, specific tissue or specific cell, or to an environmental medium. According to another embodiment of the present invention, there is provided a method of delivering one or more than one substance to an organism, or to a specific tissue or specific cells, or to an environmental medium. The method comprises providing vault-like particles comprising the substance, and administering the vault-like particles comprising the substance to the organism, tissue or cells, or to the environmental medium.

According to another embodiment of the present invention, there is provided a method of delivering vault-like particles to a specific tissue or specific cells, or to an environmental medium. The method comprises providing vault-like particles having a receptor-binding domain on the surface of the vault-like particles, and administering the vault-like particles to the tissue or cells, or to the environmental medium.

According to another embodiment of the present invention, there is provided a vault-like particle useful for sequestering the one or more than one substance within the vault-like particle. According to another embodiment of the present invention, there is provided a method of preventing damage by one or more than one substance to an organism, or to a specific tissue or specific cells, or to an environmental medium, by sequestering the one or more than one substance within a vault-like particle. The method comprises providing vault-like particles comprising one or more than one substance-binding domain within the vault-like particle, administering the vault-like particles to the organism, tissue or cells, or to the environmental medium, and allowing the vault-like particles to sequester the one or more than one substance within the vault-like particles.

Advantageously, both vaults and vault-like particles are resistant to degradation, such as intracellular degradation or environmental degradation, and therefore, can be used to deliver substances to or to remove substances from both living and non-living systems. The embodiments of the present invention will now be disclosed in greater detail.

As used in this disclosure, "MVP," "VPARP" and "TEP1" means the full naturally occurring polypeptide sequence. "vRNA" means the full naturally occurring polynucleotide sequence. As will be appreciated by one of ordinary skill in the art with reference to this disclosure, the actual sequence of any of MVP, VPARP, TEP1 and vRNAs can be from any species suitable for the purposes disclosed in this disclosure, even though reference or examples are made to sequences from specific species. For example, when delivering substances to human organs or tissues, it is preferred to use human vaults or vault-like particles comprising human sequences for MVP, VPARP, TEP1 and vRNAs. Further, as will be appreciated by one of ordinary skill in the art with reference to this disclosure, there are some intraspecies variations in the sequences of MVP, VPARP, TEP1 and vRNAs that are not relevant to the purposes of the present invention. Therefore, references to MVP, VPARP, TEP1 and vRNAs are intended to include such intraspecies variants.

As used in this disclosure, the term "vault" or "vault particle," as compared to the term "vault-like particle" defined below, refers to a naturally occurring macro-molecular structure having MVP, VPARP, TEP1 and one or more than one vRNA, whether purified from natural sources or generated through recombinant technology.

As used in this disclosure, the term "vault-like particle" refers to a macro-molecular structure comprising any of the following:
1) MVP without VPARP, TEP1 and vRNA;
2) MVP and either VPARP or a portion of VPARP, without TEP1 and vRNA;
3) MVP and TEP1 or a portion of TEP1 with or without the one or more than one vRNA, and without VPARP;
4) MVP without VPARP, TEP1 and vRNA, where the MVP is modified to attract a specific substance within the vault-like particle, or modified to attract the vault-like particle to a specific tissue, cell type or environmental medium, or modified both to attract a specific substance within the vault-like particle and to attract the vault particle to a specific tissue, cell type or environmental medium; and
5) MVP, and either VPARP or a portion of VPARP, or TEP1 or a portion of TEP1 with or without the one or more than one vRNA, or with both VPARP or a portion of VPARP, and TEP1, with or without the one or more than one vRNA, where one or more than one of the MVP, VPARP or portion of VPARP and TEP1 is modified to attract a specific substance within the vault-like particle, or modified to attract the vault particle to a specific tissue, cell type or environmental medium, or modified both to attract a specific substance within the vault-like particle and to attract the vault particle to a specific tissue, cell type or environmental medium.

As used in this disclosure, the term "modified" and variations of the term, such as "modification," means one or more than one change to the naturally occurring sequence of MVP, VPARP or TEP1 selected from the group consisting of addition of a polypeptide sequence to the C-terminal, addition of a polypeptide sequence to the N-terminal, deletion of between about 1 and 100 amino acid residues from the C-terminal, deletion of between about 1 and 100 amino acid residues from the N-terminal, substitution of one or more than one amino acid residue that does not change the function of the polypeptide, as will be appreciated by one of ordinary skill in the art with reference to this disclosure, such as for example, an alanine to glycine substitution, and a combination of the preceding.

As used in this disclosure, the term "human" means "*Homo sapiens.*"

As used in this disclosure, the terms "organism," "tissue" and "cell" include naturally occurring organisms, tissues and cells, genetically modified organisms, tissues and cells, and pathological tissues and cells, such as tumor cell lines in vitro and tumors in vivo.

As used in this disclosure, the term "environmental medium" means a non-living composition, composite, material, or mixture.

As used in this disclosure, the term "administering" includes any suitable route of administration, as will be appreciated by one of ordinary skill in the art with reference to this disclosure, including direct injection into a solid organ, direct injection into a cell mass such as a tumor, inhalation, intraperitoneal injection, intravenous injection, topical application on a mucous membrane, or application to or dispersion within an environmental medium, and a combination of the preceding. In one embodiment, the dosage of vaults or vault-like particles, with or without one or more than one substance enclosed within the vaults or vault-like particles, is between about 0.1 and 10,000 micrograms per kilogram of body weight or environmental medium. In another embodiment, the dosage of vaults or vault-like particles, with or without one or more than one substance enclosed within the vaults or vault-like particles, is between about 1 and 1,000 micrograms per kilogram of body weight or environmental medium. In another embodiment, the dosage of vaults or vault-like particles, with or without one or more than one substance enclosed within the vaults or vault-like particles, is between about 10 and 1,000 micrograms per kilogram of body weight or environmental medium. For intravenous injection and intraperitoneal injection, the dosage is preferably administered in a final volume of between about 0.1 and 10 ml. For inhalation the dosage is preferably administered in a final volume of between about 0.01 and 1 ml. As will be appreciated by one of ordinary skill in the art with reference to this disclosure, the dose can be repeated a one or more than one of times as needed using the same parameters to effect the purposes disclosed in this disclosure.

As used in this disclosure, "MS2" means the Enterobacteriophage MS2 coat protein, which is an RNA-binding protein that specifically binds a 21-nt RNA stem-loop with high affinity.

As used in this disclosure, the term "comprise" and variations of the term, such as "comprising" and "comprises," are not intended to exclude other additives, components, integers or steps.

In one embodiment, the present invention is a method of using naturally occurring vaults as carrier molecules to deliver one or more than one substance to an organism, or to a specific tissue or specific cells, or to an environmental medium. The method comprises, first, providing vaults. In one embodiment, the vaults are purified from natural sources, such as mammalian liver or spleen tissue, using methods known to those with skill in the art, such as for example tissue homogenization, differential centrifugation, discontinuous sucrose gradient fractionation and cesium chloride gradient fractionation. In another embodiment, the vaults are made using recombinant technology. Next, the one or more than one substance is incorporated into the provided vaults. In a preferred embodiment, incorporation is accomplished by incubating the vaults with the one or more than one substance at an appropriate temperature and for an appropriate time, as will be appreciated by one of ordinary skill in the art with reference to this disclosure. The vaults containing the one or more than one substance are then purified, such as for example sucrose gradient fractionation, as will be appreciated by one of ordinary skill in the art with reference to this disclosure. In a preferred embodiment, the one or more than one substance is selected from the group consisting of an enzyme, a pharmaceutical agent, a plasmid, a polynucleotide, a polypeptide, a sensor and a combination of the preceding. Next, the vaults comprising the one or more than one substance are administered to an organism, to a specific tissue, to specific cells, or to an environmental medium. Administration is accomplished using any suitable route, as will be appreciated by one of ordinary skill in the art with reference to this disclosure.

According to another embodiment of the present invention, there is provided a vault-like particle useful as a carrier molecule for delivering one or more than one substance to an organism, to a specific tissue, to specific cells, or to an environmental medium, or useful for preventing damage by one or more than one substance to an organism, to a specific tissue, to specific cells, or to an environmental medium, by sequestering the one or more than one substance within a vault-like particle. The vault-like particle comprises MVP or modified MVP, and can further comprise VPARP or modified VPARP, a portion of VPARP or a modified portion of VPARP, and TEP1 or modified TEP1, a portion of TEP1 or a modified portion of TEP1 with or without the one or more than one vRNA. In a preferred embodiment, the modifications are designed to attract a specific substance within the vault-like particle, to attract the vault-like particle to a specific tissue or cell type, or both to attract a specific substance within the vault-like particle and to attract the vault particle to a specific tissue or cell type.

In one embodiment, the MVP is human MVP, SEQ ID NO:1, GenBank accession number CAA56256, encoded by the cDNA, SEQ ID NO:2, GenBank accession number X79882. In another embodiment, the VPARP is human VPARP, SEQ ID NO:3, GenBank accession number AAD47250, encoded by the cDNA, SEQ ID NO:4, GenBank accession number AF158255. In another embodiment, the TEP1 is human TEP1, SEQ ID NO:5, GenBank accession number AAC51107, encoded by the cDNA, SEQ ID NO:6, GenBank accession number U86136. In another embodiment, the vRNA is human vRNA, SEQ ID NO:7, GenBank accession number AF045143, SEQ ID NO:8, GenBank accession number AF045144, or SEQ ID NO:9, GenBank accession number AF045145, or a combination of the preceding.

In one embodiment, the MVP is *Rattus norvegicus* MVP, SEQ ID NO:10, GenBank accession number AAC52161, encoded by the cDNA, SEQ ID NO:11, GenBank accession number U09870. In another embodiment, the TEP1 is *Rattus norvegicus* TEP1, SEQ ID NO:12, GenBank accession number AAB51690, encoded by the cDNA, SEQ ID NO:13, GenBank accession number U89282. In another embodiment, the vRNA is *Rattus norvegicus* vRNA, SEQ ID NO:14, GenBank accession number Z11171. As can be seen, *Rattus norvegicus* MVP and human MVP share over 90% homology.

The following disclosure of vault protein modifications references specific examples using specific human and *Rattus norvegicus* sequences of MVP, VPARP and TEP1 sequences, however, as will be appreciated by one of ordinary skill in the art with reference to this disclosure, corresponding modifications can be made using other sequences of these species and can be made using sequences from other species as appropriate for the disclosed purposes.

According to one embodiment of the present invention, there is provided a vault-like particle comprising, consisting essentially of, or consisting of modified MVP. In a preferred embodiment, the modification comprises adding an amino acid sequence to the N-terminal of the MVP which results in one or more than one substance-binding domain within the vault-like particle. When each copy of the MVP is modified in this manner, one or more than one of the substance-binding domains, such as 96 substance-binding domains, is present in each vault-like particle, however, vault-like particles can also be assembled from a mixture of MVP with the N-terminal modified and MVP without the N-terminal modified, to create vault-like particle with less than 96 substance-binding domains in the vault-like particle, and the added amino acid terminal sequences can be polymerized as will be appreciated by one of ordinary skill in the art with reference to this disclosure to create more than 96 substance-binding domains in the vault-like particle.

In a preferred embodiment, there is provided a vault-like particle comprising, consisting essentially of, or consisting of an MVP modified by adding a peptide to the N-terminal to create a one or more than one of heavy metal binding domains. In a preferred embodiment, the heavy metal binding domains bind a heavy metal selected from the group consisting of cadmium, copper, gold and mercury. In a preferred embodiment, the peptide added to the N-terminal is a cysteine-rich peptide (CP), such as for example, SEQ ID NO:15, the MVP is human MVP, SEQ ID NO:1, and the modification results in CP-MVP, SEQ ID NO:16, encoded by the cDNA, SEQ ID NO:17. In another preferred embodiment, the cysteine-rich peptide is SEQ ID NO:15, the MVP is *Rattus norvegicus* MVP, SEQ ID NO:10, and the modification results in CP-MVP, SEQ ID NO:18, encoded by the cDNA, SEQ ID NO:19. These embodiments are particularly useful because vault-like particles consisting of CP-MVP, SEQ ID NO:16 or SEQ ID NO:18, are stable without the presence of other vault proteins.

In another embodiment, there is provided a vault-like particle comprising, consisting essentially of, or consisting of an MVP modified by adding a peptide to the N-terminal to create one or more than one polynucleotide-binding domain. In a preferred embodiment, the peptide is a non-specific polynucleotide-binding peptide, such as for example, HisT7, SEQ ID NO:20, encoded by the cDNA, SEQ ID NO:21, or a polylysine such as SEQ ID NO:22, encoded by the cDNA, SEQ ID NO:23, the MVP is human MVP, SEQ ID NO:1, and the modification results in HisT7-MVP, SEQ ID NO:24, encoded by the cDNA, SEQ ID NO:25, or in polylysine-MVP, SEQ ID NO:26, encoded by the cDNA, SEQ ID NO:27, respectfully. In another preferred embodiment, the peptide is a non-specific polynucleotide-binding peptide, such as for example, HisT7, SEQ ID NO:20, encoded by the cDNA, SEQ ID NO:21, or a polylysine such as SEQ ID NO:22, encoded by the cDNA, SEQ ID NO:23, the MVP is *Rattus norvegicus* MVP, SEQ ID NO:10, and the modification results in HisT7-MVP, SEQ ID NO:28, encoded by the cDNA, SEQ ID NO:29, or in polylysine-MVP, SEQ ID NO:30, encoded by the cDNA, SEQ ID NO:31, respectfully. HisT7-MVP, SEQ ID NO:24 and SEQ ID NO:28, are examples of modified MVP that can also be used to bind specific antibodies within the vault-like particle, in these cases, the T7 monoclonal antibody, but corresponding modifications can be made to bind other specific antibodies, as will be appreciated by one of ordinary skill in the art with reference to this disclosure. In another preferred embodiment, the peptide is a specific DNA binding peptide, such as for example, GAL4, SEQ ID NO:32, encoded by the cDNA, SEQ ID NO:33, the MVP is human MVP, SEQ ID NO:1, and the modification results in GAL4-MVP, SEQ ID NO:34, encoded by the cDNA, SEQ ID NO:35. In another preferred embodiment, the peptide is a specific DNA binding peptide, such as for example, GAL4, SEQ ID NO:32, encoded by the cDNA, SEQ ID NO:33, the MVP is *Rattus norvegicus* MVP, SEQ ID NO:10, and the modification results in GAL4-MVP, SEQ ID NO:36, encoded by the cDNA, SEQ ID NO:37. In another preferred embodiment, the peptide is a specific RNA binding peptide, such as for example, MS2, SEQ ID NO:38, encoded by the cDNA, SEQ ID NO:39, the MVP is human MVP, SEQ ID NO:1, and the modification results in MS2-MVP, SEQ ID NO:40, encoded by the cDNA, SEQ ID NO:41. In another preferred embodiment, the peptide is an RNA binding peptide, such as for example, MS2, SEQ ID NO:38, encoded by the cDNA, SEQ ID NO:39, the MVP is *Rattus norvegicus* MVP, SEQ ID NO:10, and the modification results in MS2-MVP, SEQ ID NO:42, encoded by the cDNA, SEQ ID NO:43.

In another embodiment, there is provided a vault-like particle comprising, consisting essentially of, or consisting of an MVP modified by adding a peptide to the N-terminal to create a sensor in the vault-like particle. The sensor can be any suitable sensor, as will be appreciated by one of ordinary skill in the art with reference to this disclosure, such as for example, a chemical sensor such as a cyclic-AMP binding protein, an ionic sensor such as a calcium or potassium sensor, a microorganism sensor such an antibody specific for *E. coli*, an optical sensor such as a quantum dot, and a pH sensor such as green fluorescence protein. In a preferred embodiment, the sensor is a fluorescent protein, such as green fluorescent protein (GL), SEQ ID NO:44, encoded by the cDNA, SEQ ID NO:45, the MVP is human MVP, SEQ ID NO:1, and the modification results in GL-MVP, SEQ ID NO:46, encoded by the cDNA, SEQ ID NO:47. In another preferred embodiment, the sensor is a fluorescent protein, such as green fluorescent protein (GL), SEQ ID NO:44, encoded by the cDNA, SEQ ID NO:45, the MVP is *Rattus norvegicus* MVP, SEQ ID NO:10, and the modification results in GL-MVP, SEQ ID NO:48, encoded by the cDNA, SEQ ID NO:49.

In another embodiment, there is provided a vault-like particle comprising MVP or modified MVP, and further comprising VPARP or a portion of VPARP comprising at least about 150 consecutive residues of VPARP, and modified by adding a peptide to either the C-terminal or the N-terminal to create a one or more than one of substance-binding domains or a one or more than one of sensors within the vault-like particles having the same purposes as disclosed with reference to modified MVP in this disclosure. By way of example only, in one embodiment, the residues are from about residue 1562 to residue 1724 of human VPARP, SEQ ID NO:3. In another embodiment, the residues are from about residue 1473 to residue 1724 of human VPARP, SEQ ID NO:3. The substance-binding domains on the VPARP or portion of VPARP serve the same functions as disclosed in this disclosure with respect to N-terminal modifications of MVP. For example, in one embodiment, the vault-like particles comprise residues 1473-1724 of VPARP, SEQ ID NO:3, modified by adding CP, SEQ ID NO:15, to the N-terminal, to create (1473-1724)CP-VPARP, SEQ ID NO:50, encoded by the cDNA, SEQ ID NO:51. In another embodiment, the vault-like particles comprise VPARP, SEQ ID NO:3, modified by adding CP, SEQ ID NO:15, to the N-terminal, to create CP-VPARP, SEQ ID NO:52, encoded by the cDNA, SEQ ID NO:53. In one embodiment, the vault-like particles comprise residues 1473-1724 of VPARP, SEQ ID NO:3, modified by adding GAL4, SEQ ID NO:32, to the N-terminal, to create GAL4-(1473-1724)VPARP, SEQ ID NO:54, encoded by the cDNA, SEQ ID NO:55. In another embodiment, the vault-like particles comprise VPARP, SEQ ID NO:3, modified by adding GAL4, SEQ ID NO:32, to the N-terminal, to create GAL4-VPARP, SEQ ID NO:56, encoded by the cDNA, SEQ ID NO:57. In another embodiment, the vault-like particles comprise residues 1473-1724 of VPARP, SEQ ID NO:3, modified by adding GL, SEQ ID NO:44, to the N-terminal, to create GL-(1473-1724)VPARP, SEQ ID NO:58, encoded by the cDNA, SEQ ID NO:59. In another embodiment, the vault-like particles comprise VPARP, SEQ ID NO:3, modified by adding GL, SEQ ID NO:44, to the N-terminal, to create GL-VPARP, SEQ ID NO:60, encoded by the cDNA, SEQ ID NO:61. In another embodiment, the vault-like particles comprise residues 1473-1724 of VPARP, SEQ ID NO:3, modified by adding MS2, SEQ ID NO:38, to the N-terminal, to create MS2-(1473-1724)VPARP, SEQ ID NO:62, encoded by the cDNA, SEQ ID NO:63. In another embodiment, the vault-like particles comprise VPARP, SEQ ID NO:3, modified by adding MS2, SEQ ID NO:38, to the N-terminal, to create MS2-VPARP, SEQ ID NO:64, encoded by the cDNA, SEQ ID NO:65. In another embodiment, the vault-like particles comprise residues 1473-1724 of VPARP, SEQ ID NO:3, modified by adding a *Photinus pyralis* luciferase (LUC), SEQ ID NO:66 GenBank accession number P08659, encoded by the pGL3-Basic vector SEQ ID NO:67, GenBank accession number U47295 to the N-terminal, to create LUC-(1473-1724)VPARP, SEQ ID NO:68, encoded by the cDNA, SEQ ID NO:69. In another embodiment, the vault-like particles comprise VPARP, SEQ ID NO:3, modified by adding LUC, SEQ ID NO:66, to the N-terminal, to create LUC-VPARP, SEQ ID NO:71, encoded by the cDNA, SEQ ID NO:72. Further, as will be appreciated by one of ordinary skill in the art with reference to this disclosure, the present invention also includes corresponding modifications to the C-terminal of VPARP or a portion of VPARP, and serve the same function. In a preferred embodiment, the substance binding domain binds the enzyme adenosine deaminase.

According to one embodiment of the present invention, there is provided a vault-like particle comprising, consisting essentially of, or consisting of MVP modified by adding an amino acid sequence to the C-terminal of the MVP which results in one or more than one receptor-binding domain, such as a protein targeting domain, on the surface of the vault-like particle. When each copy of the MVP is modified in this manner, one or more than one of the receptor-binding domains, such as 96 receptor-binding domains, is present on each vault-like particle, however, vault-like particles can also be assembled from a mixture of MVP with the C-terminal modified and MVP without the C-terminal modified, to create vault-like particle with less than 96 receptor-binding domains on the vault-like particle.

In a preferred embodiment, there is provided a vault-like particle comprising, consisting essentially of, or consisting of an MVP modified by adding a peptide to the C-terminal to create a one or more than one of eukaryotic cell receptor-binding domains on the exterior of the vault-like particles. In a preferred embodiment, the eukaryotic cell receptor-binding domain is generally non-specific. For example, in one embodiment, the peptide is Antennapedia (ANT), SEQ ID NO:72, encoded by the cDNA, SEQ ID NO:73, the MVP is human MVP, SEQ ID NO:1, and the modification results in MVP-ANT, SEQ ID NO:74, encoded by the cDNA, SEQ ID NO:75. In another embodiment, the peptide is ANT, SEQ ID NO:72, encoded by the cDNA, SEQ ID NO:73, the MVP is *Rattus norvegicus* MVP, SEQ ID NO:10, and the modification results in MVP-ANT, SEQ ID NO:76, encoded by the cDNA, SEQ ID NO:77. In another embodiment, the peptide is HIV-Tat (TAT), SEQ ID NO:78, encoded by the cDNA, SEQ ID NO:79, the MVP is human MVP, SEQ ID NO:1, and the modification results in MVP-TAT, SEQ ID NO:80, encoded by the cDNA, SEQ ID NO:81. In another embodiment, the peptide is TAT, SEQ ID NO:78, encoded by the cDNA, SEQ ID NO:79, the MVP is *Rattus norvegicus* MVP, SEQ ID NO:10, and the modification results in MVP-TAT, SEQ ID NO:82, encoded by the cDNA, SEQ ID NO:83. In another embodiment, the eukaryotic cell receptor-binding domain is specific to a certain type of eukaryotic cell receptor, such as for example a carcinoembryonic antigen receptor, a protein found on the surface of about 50% of all human tumors, or an epidermal growth factor (EGF) receptor. For example, in one embodiment, the peptide is anti-CEA scFv diabody (αCEA), SEQ ID NO:84, encoded by the cDNA, SEQ ID NO:85, the MVP is human MVP, SEQ ID NO:1, and the modification results in MVP-αCEA, SEQ ID NO:86, encoded by the cDNA, SEQ ID NO:87. In another embodiment, the peptide is αCEA, SEQ ID NO:84, encoded by the cDNA, SEQ ID NO:85, the MVP is *Rattus norvegicus* MVP, SEQ ID NO:10, and the modification results in MVP-αCEA, SEQ ID NO:88, encoded by the cDNA, SEQ ID NO:89. In another embodiment, the peptide is EGF, SEQ ID NO:90, encoded by the cDNA, SEQ ID NO:91, the MVP is human MVP, SEQ ID NO:1, and the modification results in MVP-EGF, SEQ ID NO:92, encoded by the cDNA, SEQ ID NO:93. In another embodiment, the peptide is EGF, SEQ ID NO:90, encoded by the cDNA, SEQ ID NO:91, the MVP is *Rattus norvegicus* MVP, SEQ ID NO:10, and the modification results in MVP-EGF, SEQ ID NO:94, encoded by the cDNA, SEQ ID NO:95.

According to one embodiment of the present invention, there is provided a vault-like particle comprising, consisting essentially of, or consisting of MVP modified by adding an amino acid sequence to the N-terminal and also modified by adding an amino acid sequence to the C-terminal. The modification of the N-terminal and the modification of the C-terminal can be any modification as disclosed in this disclosure, for the same purposes as disclosed in this disclosure. For example, the modification of the N-terminal can result in a substance-binding domain, such as for example a heavy metal binding domain or a polynucleotide binding domain, or can result in a sensor within the vault-like particle. The modification of the C-terminal can result in one or more than one receptor-binding domain on the surface of the vault-like particle. By way of example only, in one embodiment, the vault-like particle comprises, consists essentially of, or consists of MVP modified by adding GAL4, SEQ ID NO:32, to the N-terminal of human MVP, SEQ ID NO:1, and ANT, SEQ ID NO:72 to the C-terminal of human MVP, SEQ ID NO:1, to create GAL4-MVP-ANT, SEQ ID NO:96, encoded by the cDNA, SEQ ID NO:97. In another embodiment, the vault-like particle comprises, consists essentially of, or consists of MVP modified by adding GAL4, SEQ ID NO:32, to the N-terminal of *Rattus norvegicus* MVP, SEQ ID NO:10, and ANT, SEQ ID NO:72 to the C-terminal of *Rattus norvegicus* MVP, SEQ ID NO:10, to create GAL4-MVP-ANT, SEQ ID NO:98, encoded by the cDNA, SEQ ID NO:99. In another embodiment, the vault-like particle comprises, consists essentially of, or consists of MVP modified by adding GAL4, SEQ ID NO:32, to the N-terminal of human MVP, SEQ ID NO:1, and αCEA, SEQ ID NO:84 to the C-terminal of human MVP, SEQ ID NO:1, to create GAL4-MVP-αCEA, SEQ ID NO:100, encoded by the cDNA, SEQ ID NO:101. In another embodiment, the vault-like particle comprises, consists essentially of, or consists of MVP modified by adding GAL4, SEQ ID NO:32, to the N-terminal of *Rattus norvegicus* MVP, SEQ ID NO:10, and αCEA, SEQ ID NO:84 to the C-terminal of *Rattus norvegicus* MVP, SEQ ID NO:10, to create GAL4-MVP-αCEA, SEQ ID NO:102, encoded by the cDNA, SEQ ID NO:103. In another embodiment, the vault-like particle comprises, consists essentially of, or consists of MVP modified by adding GAL4, SEQ ID NO:32, to the N-terminal of human MVP, SEQ ID NO:1, and EGF, SEQ ID NO:90 to the C-terminal of human MVP, SEQ ID NO:1, to create GAL4-MVP-EGF, SEQ ID NO:104, encoded by the cDNA, SEQ ID NO:105. In another embodiment, the vault-like particle comprises, consists essentially of, or consists of MVP modified by adding GAL4, SEQ ID NO:32, to the N-terminal of *Rattus norvegicus* MVP, SEQ ID NO:10, and EGF, SEQ ID NO:90 to the C-terminal of *Rattus norvegicus* MVP, SEQ ID NO:10, to create GAL4-MVP-EGF, SEQ ID NO:106, encoded by the cDNA, SEQ ID NO:107. In another embodiment, the vault-like particle comprises, consists essentially of, or consists of MVP modified by adding GAL4, SEQ ID NO:32, to the N-terminal of human MVP, SEQ ID NO:1, and TAT, SEQ ID NO:78 to the C-terminal of human MVP, SEQ ID NO:1, to create GAL4-MVP-TAT, SEQ ID NO:108, encoded by the cDNA, SEQ ID NO:109. In another embodiment, the vault-like particle comprises, consists essentially of, or consists of MVP modified by adding GAL4, SEQ ID NO:32, to the N-terminal of *Rattus norvegicus* MVP, SEQ ID NO:1, and TAT, SEQ ID NO:78 to the C-terminal of *Rattus norvegicus* MVP, SEQ ID NO:10, to create GAL4-MVP-TAT, SEQ ID NO:110, encoded by the cDNA, SEQ ID NO:111. In one embodiment, the vault-like particle comprises, consists essentially of, or consists of MVP modified by adding MS2, SEQ ID NO:38, to the N-terminal of human MVP, SEQ ID NO:1, and ANT, SEQ ID NO:72 to the C-terminal of human MVP, SEQ ID NO:1, to create MS2-MVP-ANT, SEQ ID NO:112, encoded by the cDNA, SEQ ID NO:113. In another embodiment, the vault-like particle comprises, consists essentially of, or consists of MVP modified by adding MS2, SEQ ID NO:38, to the N-terminal of *Rattus norvegicus* MVP, SEQ ID NO:10, and ANT, SEQ ID NO:72 to the C-terminal of *Rattus norvegicus* MVP, SEQ ID NO:10, to create MS2-MVP-ANT, SEQ ID NO:114, encoded by the cDNA, SEQ ID NO:115. In another embodiment, the vault-like particle comprises, consists essentially of, or consists of MVP modified by adding MS2, SEQ ID NO:38, to the N-terminal of human MVP, SEQ ID NO:1, and αCEA, SEQ ID NO:84 to the C-terminal of human MVP, SEQ ID NO:1, to create MS2-MVP-αCEA, SEQ ID NO:116, encoded by the cDNA, SEQ ID NO:117. In another embodiment, the vault-like particle comprises, consists essentially of, or consists of MVP modified by adding MS2, SEQ ID NO:38, to the N-terminal of *Rattus norvegicus* MVP, SEQ ID NO:10, and αCEA, SEQ ID NO:84 to the C-terminal of *Rattus norvegicus* MVP, SEQ ID NO:10, to create MS2-MVP-αCEA, SEQ ID NO:118, encoded by the cDNA, SEQ ID NO:119. In another embodiment, the vault-like particle comprises, consists essentially of, or consists of MVP modified by adding MS2, SEQ ID NO:38, to the N-terminal of human MVP, SEQ ID NO:1, and EGF, SEQ ID NO:90 to the C-terminal of human MVP, SEQ ID NO:1, to create MS2-MVP-EGF, SEQ ID NO:120, encoded by the cDNA, SEQ ID NO:121. In another embodiment, the vault-like particle comprises, consists essentially of, or consists of MVP modified by adding MS2, SEQ ID NO:38, to the N-terminal of *Rattus norvegicus* MVP, SEQ ID NO:10, and EGF, SEQ ID NO:90 to the C-terminal of *Rattus norvegicus* MVP, SEQ ID NO:10, to create MS2-MVP-EGF, SEQ ID NO:122, encoded by the cDNA, SEQ ID NO:123. In another embodiment, the vault-like particle comprises, consists essentially of, or consists of MVP modified by adding MS2, SEQ ID NO:38, to the N-terminal of human MVP, SEQ ID NO:1, and TAT, SEQ ID NO:78 to the C-terminal of human MVP, SEQ ID NO:1, to create MS2-MVP-TAT, SEQ ID NO:124, encoded by the cDNA, SEQ ID NO:125. In another embodiment, the vault-like particle comprises, consists essentially of, or consists of MVP modified by adding MS2, SEQ ID NO:38, to the N-terminal of *Rattus norvegicus* MVP, SEQ ID NO:1, and TAT, SEQ ID NO:78 to the C-terminal of *Rattus norvegicus* MVP, SEQ ID NO:10, to create MS2-MVP-TAT, SEQ ID NO:126, encoded by the cDNA, SEQ ID NO:127. In one embodiment, the vault-like particle comprises, consists essentially of, or consists of MVP modified by adding polylysine, SEQ ID NO:22, to the N-terminal of human MVP, SEQ ID NO:1, and ANT, SEQ ID NO:72 to the C-terminal of human MVP, SEQ ID NO:1, to create polylysine-MVP-ANT, SEQ ID NO:128, encoded by the cDNA, SEQ ID NO:129. In another embodiment, the vault-like particle comprises, consists essentially of, or consists of MVP modified by adding polylysine, SEQ ID NO:22, to the N-terminal of *Rattus norvegicus* MVP, SEQ ID NO:10, and ANT, SEQ ID NO:72 to the C-terminal of *Rattus norvegicus* MVP, SEQ ID NO:10, to create polylysine-MVP-ANT, SEQ ID NO:130, encoded by the cDNA, SEQ ID NO:131. In another embodiment, the vault-like particle comprises, consists essentially of, or consists of MVP modified by adding polylysine, SEQ ID NO:22, to the N-terminal of human MVP, SEQ ID NO:1, and αCEA, SEQ ID NO:84 to the C-terminal of human MVP, SEQ ID NO:1, to create polylysine-MVP-αCEA, SEQ ID NO:132, encoded by the cDNA, SEQ ID NO:133. In another embodiment, the vault-like particle comprises, consists essentially of, or consists of MVP modified by adding polylysine, SEQ ID NO:22, to the N-terminal of *Rattus norvegicus* MVP, SEQ ID NO:10, and αCEA, SEQ ID NO:84 to the C-terminal of *Rattus norvegicus* MVP, SEQ ID NO:10, to create polylysine-MVP-αCEA, SEQ ID NO:134, encoded by the cDNA, SEQ ID NO:135. In another embodiment, the vault-like particle comprises, consists essentially of, or consists of MVP modified by adding polylysine, SEQ ID NO:22, to the N-terminal of human MVP, SEQ ID NO:1, and EGF, SEQ ID NO:90 to the C-terminal of human MVP, SEQ ID NO:1, to create polylysine-MVP-EGF, SEQ ID NO:136, encoded by the cDNA, SEQ ID NO:137. In another embodiment, the vault-like particle comprises, consists essentially of, or consists of MVP modified by adding polylysine, SEQ ID NO:22, to the N-terminal of *Rattus norvegicus* MVP, SEQ ID NO:10, and EGF, SEQ ID NO:90 to the C-terminal of *Rattus norvegicus* MVP, SEQ ID NO:10, to create polylysine-MVP-EGF, SEQ ID NO:138, encoded by the cDNA, SEQ ID NO:139. In another embodiment, the vault-like particle comprises, consists essentially of, or consists of MVP modified by adding polylysine, SEQ ID NO:22, to the N-terminal of human MVP, SEQ ID NO:1, and TAT, SEQ ID NO:78 to the C-terminal of human MVP, SEQ ID NO:1, to create polylysine-MVP-TAT, SEQ ID NO:140, encoded by the cDNA, SEQ ID NO:141. In another embodiment, the vault-like particle comprises, consists essentially of, or consists of MVP modified by adding polylysine, SEQ ID NO:22, to the N-terminal of *Rattus norvegicus* MVP, SEQ ID NO:1, and TAT, SEQ ID NO:78 to the C-terminal of *Rattus norvegicus* MVP, SEQ ID NO:10, to create polylysine-MVP-TAT, SEQ ID NO:142, encoded by the cDNA, SEQ ID NO:143.

According to another embodiment of the present invention, there is provided a vault-like particle comprising MVP and VPARP or a portion of VPARP, where the MVP is modified by adding an amino acid sequence to the N-terminal or is modified by adding an amino acid sequence to the C-terminal, or is modified both by adding an amino acid sequence to the N-terminal and by adding an amino acid sequence to the C-terminal, and where the VPARP or portion of VPARP is modified by adding an amino acid sequence to the N-terminal or is modified by adding an amino acid sequence to the C-terminal, or is modified both by adding an amino acid sequence to the N-terminal and by adding an amino acid sequence to the C-terminal. The modifications can be any modification as disclosed in this disclosure, for the same purposes as disclosed in this disclosure.

In another embodiment of the present invention, there is provided a method of preventing damage by one or more than one substance to an organism, to a specific tissue, to specific cells, or to an environmental medium, by sequestering the one or more than one substance within a vault-like particle. The method comprises providing vault-like particles according to the present invention. The method further comprises administering the vault-like particles to the organism, tissue, cells or environmental medium, and allowing the vault-like particles to sequester the one or more than one substance within the vault-like particles. In one embodiment, the vault-like particles comprise, consist essentially of or consist of a modified MVP according to the present invention. In another embodiment, the vault-like particles comprise a modified VPARP or portion of VPARP according to the present invention. In another embodiment, the vault-like particles comprise both a modified MVP according to the present invention, and a modified VPARP or portion of VPARP according to the present invention. In a preferred embodiment, the vault-like particles comprise, consist essentially of or consist of MVP modified by adding a peptide to the N-terminal to create a one or more than one of heavy metal binding domains. In one embodiment, the one or more than one substance is a heavy metal selected from the group consisting of cadmium, copper, gold and mercury. In another embodiment, the one or more than one substance is a toxin selected from the group consisting of arsenate, dioxin, an organochlorine, a pentachlorophenol and a polychlorinated biphenyl. In a preferred embodiment, the providing step comprises expressing the vault-like particles in a eukaryotic organisms, such as for example an *Acanthomoeba* sp., yeast or *Dictostelium discoidieum*, capable of proliferating in contaminated soil, and the administering step comprises introducing the organisms with the expressed vault-like particles into the contaminated soil. For example, vault-like particles comprising an arsenate reductase enzyme within the vault-like particles can be expressed in the organisms and used to detoxify soil. For example, in one embodiment, modified MVP is provided comprising one or more than one arsenate-binding domain at the N-terminal. Arsenate reductase enzyme is cloned with residues 1473-1724 of human VPARP, SEQ ID NO:3 at either the C-terminal or the N-terminal. Both proteins are co-expressed in a primitive eukaryotic organisms, such as *acanthomoeba*, yeast or *Dictostelium discoidieum*, capable of proliferating in contaminated soil. The organisms engineered to contain the two modified proteins are introduced into contaminated soil, where they are exposed to the environmental toxin, such as arsenate. The expressed vault-like particles, comprising 96 or more copies of the arsenate-binding domain and the detoxification enzyme, arsenate reductase within the vault-like particles, then sequester and detoxify the environmental toxin, arsenate in the environmental medium.

In another embodiment of the present invention, there is provided a method of delivering one or more than one substance to an organism, to a specific tissue, to specific cells, or to an environmental medium. The method comprises providing vault-like particles according to the present invention comprising the one or more than one substance. The method further comprises administering the vault-like particles comprising the one or more than one substance to the organism, tissue, cells or environmental medium. In one embodiment, the vault-like particles comprise, consist essentially of or consist of a modified MVP according to the present invention, in addition to the one or more than one substance. In another embodiment, the vault-like particles comprise a modified VPARP or modified portion of VPARP according to the present invention. In another embodiment, the vault-like particles comprise both a modified MVP according to the present invention, and a modified VPARP or modified portion of VPARP according to the present invention. In a preferred embodiment, the one or more than one substance is selected from the group consisting of an enzyme, a pharmaceutical agent, a plasmid, a polynucleotide, a polypeptide, a sensor and a combination of the preceding. In a particularly preferred embodiment, the substance is adenosine deaminase.

In another embodiment of the present invention, there is provided a method of delivering one or more than one sensor to an organism, to a specific tissue, to specific cells, or to an environmental medium. The method comprises providing a vault-like particle comprising the one or more than one sensor and administering the vault-like particle to the organism, specific tissue, specific cells, or environmental medium. In one embodiment, the vault-like particles comprise, consist essentially of or consist of a modified MVP according to the present invention, in addition to the one or more than one sensor. In another embodiment, the vault-like particles comprise a modified VPARP or modified portion of VPARP according to the present invention. In another embodiment, the vault-like particles comprise both a modified MVP according to the present invention, and a modified VPARP or modified portion of VPARP according to the present invention. The sensor can be any suitable sensor, as will be appreciated by one of ordinary skill in the art with reference to this disclosure, such as for example, a chemical sensor such as a cyclic-AMP binding protein, an ionic sensor such as a calcium or potassium sensor, a microorganism sensor such an antibody specific for *E. coli*, an optical sensor such as a quantum dot, and a pH sensor such as green fluorescence protein. In a preferred embodiment, the sensor is a fluorescent sensor.

In another embodiment, the present invention is a method of detecting a signal from a sensor within an organism, or a specific tissue or specific cells. The method comprises delivering one or more than one sensor to an organism, to a specific tissue, to specific cells, or to an environmental medium, according to a method of the present invention. Then, the presence of the sensor is detected. Detection is performed using standard techniques, such as for example, fluorometry or spectrophotometry. This method can be used, for example, to determine the pH within cells, where the sensor is a pH dependent fluorescent sensor, as will be appreciated by one of ordinary skill in the art with reference to this disclosure.

According to another embodiment of the present invention, there is provided a method of making vault-like particles according to the present invention. The method comprises creating polynucleotide sequences encoding one or more than one polypeptide selected from the group consisting of MVP, modified MVP, VPARP, a portion of VPARP, modified VPARP, a modified portion of VPARP, TEP1, a portion of TEP1, modified TEP1 and a modified portion of TEP1, using standard molecular biological procedures, such as polymerase chain reaction and specific oligonucleotides, as will be appreciated by one of ordinary skill in the art with reference to this disclosure. Preferably, the polynucleotide sequences are used to generate a bacmid DNA that is used to generate a baculovirus comprising the sequence. The baculovirus is then used to infect insect cells for protein production using an in situ assembly system, such as the baculovirus protein expression system, according to standard techniques, as will be appreciated by one of ordinary skill in the art with reference to this disclosure. Advantageously, we have used the baculovirus protein expression system to produce milligram quantities of vault-like particles, and this system can be scaled up to allow production of gram quantities of vault-like particles according to the present invention.

In another embodiment of the present invention, there is provided a method of making vault-like particles having one or more than one substance, such as an enzyme, a pharmaceutical agent, a plasmid, a polynucleotide, a polypeptide, a sensor and a combination of the preceding, within the vault-like particles. The method comprises making the vault-like particles according to a method of the present invention. Next, the vault-like particles are purified using, such as for example, standard procedures over sucrose gradients. Then, the vault-like particles are co-incubated with one or more than one substance, until the one or more than one substance equilibrates within the vault-like particles or until enough of the one or more than one substance is loaded in the vault-like particles for the intended purpose.

Although the present invention has been discussed in considerable detail with reference to certain preferred embodiments, other embodiments are possible. Therefore, the scope of the appended claims should not be limited to the description of preferred embodiments contained in this disclosure. All references cited herein are incorporated by reference to their entirety.

SEQUENCE LISTING (143 sequences)

SEQ ID NO: 1 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 2 - DNA, 2682 bp, Homo sapiens
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 3 - protein, 1724 aa, Homo sapiens [sequence omitted]

SEQ ID NO: 4 - DNA, 5175 bp, Homo sapiens
atggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 5 - protein, 2627 aa, Homo sapiens
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLPSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHGKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAACRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQQLMLPHGRLSLVTGQSGQGKTAFLASLVSALQAPDGAKVAPLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 6 - DNA, 7884 bp, Homo sapiens
atggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctccctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgggaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcgtatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcacggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcatgtcggatctcagaactgaagagctacctaagcagacagaaagggataacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacagctgatgctgccccacggaaggctgagcctggtgacggggcagtcaggacagggcaagacagccttcctggcatctcttgtgtcagccctgcaggctcctgatggggccaaggtggcaccattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatga

SEQ ID NO: 7 - RNA, 98 nt, Homo sapiens
ggcuggcuuuagcucagcgguuacuucgacaguucuuuaauugaaacaagcaaccugucuggguuguucgagacccgcgggcgcucuccaguccuuuu

SEQ ID NO: 8 - RNA, 88 nt, Homo sapiens
ggcuggcuuuagcucagcgguuacuucgaguacauuguaaccaccucucugggugguucgagacccgcgggugcuuuccagcucuuuu

SEQ ID NO: 9 - RNA, 88 nt, Homo sapiens
ggcuggcuuuagcucagcgguuacuucgcgugucaucaaaccaccucucuggguuguucgagacccgcgggcgcucuccagcccucuu

SEQ ID NO: 10 - protein, 861 aa, Rattus norvegicus
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 11 - DNA, 2586 bp, Rattus norvegicus
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 12 - protein, 2629 aa, Rattus norvegicus
MEKLCGYVPVHPDILSLKNRCLTMLSDIQPLEKIHGQRSVNPDILSLENRCLTLLPDLQPMEKIHGQRSVHPDILSSENRCLTLLPDLQSLEKLCGHMSSHPDVLSLENRCLATLPTVKRTVSSGPLLQCLHRSHTAQADLRDPNFRNCLFPEPPTIEAPCFLKELDLPTGPRALKSMSATARVQEVALGQRCVSEGKELQEEKESAEVPMPLYSLSLGGEEEEVVGAPVLKLTSGDSDSHPETTDQILQEKKMALLTLLCSAMASSVNVKDASDPTRASIHEVCSALAPLEPEFILKASLYARQQLNLRDIANIVLAVAALLPACRPHVRRYYSAIVHLPSDWIQVAEFYQSLAEGDEKKLVPLPACLRAAMTDKFAQFDEYQLAKYNPRKHRSKTRSRQPPRPQRTKPPFSESGKCFPKSVWPLKNEQISFEAAYNAVSEKKRLPRFTLKKLVEQLHIHEPAQHVQALLGYRYPSTLELFSRSHLPGPWDSSRAGQRMKLQRPETWERELSLRGNRASVWEELIDNGKLPFMAMLRNLCNLLRTGISAHHHELVLQRLQHEKSVIHSRQFPFRFLNAHDSLDRLEAQLRSKASPFPSNTTLMKRIMIRNSKKIKRPANPRYLCTLTQRQLRAAMAIPVMYEHLKREKLRLHKARQWTCDLELLERYRQALETAVNISVKHNLPPLPGRTLLVYLTDANANRLCPKSHLQGPPLNYVLLLIGMMMARAEQTTVWLCGTGTVKTPVLTADEGILKTAIKLQAQVQELEENDEWPLETFEKYLLSLAVRRTPIDRVILFGQRMDTELLNVAKQIIWQHVNSKCLFVSVLLRKMQYMSPNLNPNDVTLSGCTDGILKFIAEHGASRLLEHVGQLDKIFKIPPPPGKTKVSPLRPLEENNPGPFVPISQHGWRNIRLFISSTFRDMHGERDLLMRSVLPALQARAFPHRISLHAIDLRWGITEEETRRNRQLEVCLGEVENSQLFVGILGSRYGYTPPSYDLPDHPHFHWTQRYPSGRSVTEMEVMQFLNRGQRSEPSDQALIYFRDPGFLSSVPDVWKPDFISESEEAAHRVSELKRFLQEQKEVTCRRYSCEWGGVAAGRPYTGGLEEFGQLVLQDVWSVIQKRYLQPGAQLEQPGSISEEDLIQASFQQLKSPPSPARPRLLQDTVQQLMLPHGRLSLVIGQAGQGKTAFLASLVSALKVPDQPNVAPFVFFHFSAARPDQCLAFNLLRRLCTHLHQKLGEPSALPSTYRGLVWELQQKLLLKSAQWLQPGQTLVLIIDGADKLVDHNGQLISDWIPKSLPRRVHLVLSVSSDSGLGETLQQSQSAYVVALGSLVPSSRAQLVREELALYGKRLEESPFNNQMRLLLAKQGSSLPLYLHLVTDYLRLFTLYEQVSERLRTLPATLPLLLQHILSTLEQEHGHNVLPQALTALEVTHSGLTVDQLHAVLSTWLTLPKETKSWEEAVAASHSGNLYPLAPFAYLVQSLRSLLGEGPVERPGARLCLSDGPLRTAVKRRYGKRLGLEKTAHVLIAAHLWKMCDPDASGTFRSCPPEALKDLPYHLLQSGNHGLLAKFLTNLHVVAAYLEVGLVPDLLEAYELYASSKPEVNQKLPEADVAVFHNFLKQQASLLTQYPLLLLQQAASQPEESPVCCQAPLLTQRWHNQCILKWINKPQTLKGQQSLSLPISSSPTAVAFSPNGQRAAVGTAGGTIYLLNLRTWQEEKALVSGCDGISSFAFLSDTALFLTTFDGLLELWDLQHGCWVFQTKAHQYQITGCCLSPDRRLLATVCLGGYVKLWDTVQGQLAFQYTHPKSLNCITFHPEGQVVATGNWSGIVTFFQADGLKVTKELGGPGPSVRTLAFSAPGKVVALGRIDGTVELWAWQEGTRLAAFPAQCGGVSTVLFLHAGGRFLTAGEDGKAQLWSGFLGRPRGCLGSLYLSPALSVALNPDGDQVAVGYRGDGIKIYRISSGPQEAQCQELNVAVSALVWLSPSVLVSGAEDGSLHGWMLRRNSLQSLWLSSVCQKPVLGLAASQEFLASASEDFTVRLWPRQLLTQPHAVEELPCAAELRGHEGPVCCCSFSPDGRILATAGRDRNLLCWDVKVAQAPLLIHTFSSCHRDWITGCTWTKDNILISCSSDGSVGLWNPEAGQQLGQFPGHQSAVSAVVAVEEHIVSVSRDGTLKVWDRQGVELTSIPAHSGPISQCAAALEPRPAGQPGSELMVVTVGLDGATKLWHPLLVCQIHTLQGHSGPVTAAAASEASGLLLTSDNSSVRLWQIPKEADDTCKPRSSAVITAVAWAPDGSLVVSGNEAGELTLWQKAQAVATARAPGRVSDLIWCSANAFFVLSANENVSEWQVELRKGSTCTNFRLYLKRVLQEDLGVLTGMALAPDGQSLILMKEDVELLQMKPGSTPSSICRRYAVHSSILCTSKDYGLFYLQQGNSGSLSILEQEESGKFEKTLDFNLNLNNPNGSPVSITQAEPESGSSLLCATSDGMLWNLSECTPEGEWVVDNIWQKKSRNPKSRTPGTDSSPGLFCMDSWVEPTHLKARQCKKIHLGSVTALHVLPGLLVTASEDRDVKLWERPSMQLLGLFRCEGPVSCLEPWMEPSSPLQLAVGDAQGNLYFLSWE

SEQ ID NO: 13 - DNA, 7890 bp, Rattus norvegicus
atggagaaactctgtggttatgtgcctgtccacccagacatcctctccttgaagaatcggtgcctgaccatgctctctgacatccaacccctggagaaaatacatggacagagatctgtcaacccagacatcctgtccttggagaaccggtgcctgaccttgctccctgatctccagcccatggagaaaatacatggacagagatctgtccacccagacatcctctcctcagagaaccggtgtctgaccttgctccctgacctccagtccctggagaagctatgtggacatatgtctagtcacccagacgtcctctctttggagaaccgatgtcttgctaccctcccgactgtaaagagaactgtttcgagtggccccttgctccagtgtcttcacagatctcatacggcacaagctgatctgcgtgacccgaactttcgcaactgcctgttccctgagcctcctaccatagaggctccatgtttcttgaaggaactagaccttccaactggacccagggccctgaaatccatgtctgctacagctcgagttcaggaagtagctttgggtcagcggtgcgtctcagaaggaaaggaattgcaggaagaaaaagaaagcgcagaagtcccgatgcctttgtacagtctaagcttggggggagaagaagaagaagtggtgggggcaccggtcctaaaactcacatctggagactctgactctcaccctgaaaccactgaccagatcctgcaggagaagaagatggctctcttgaccttgctgtgctcagctatggcctcaagtgtgaatgtgaaagatgcctccgatcctacccgggcatctatccatgaagtctgcagtgcgctggcccccttggaacctgagttcatccttaaggcatctttgtatgctaggcagcagcttaacctccgggacatagccaatatagtgttggccgtggctgccctcttgccagcctgccgcccccatgtacgacggtattactctgccattgttcacctgccttcagactggatccaggtagccgagttctaccagagcctggcagaaggggatgagaagaagttggtgcccctgcctgcctgcctccgtgctgccatgactgacaaatttgcccagtttgatgagtaccagctagcgaagtacaacccacggaaacaccgatccaagacacgttcccgccagccaccccgccctcaaaggacaaaacctccattttcagagagtgggaaatgttttccaaagagcgtttggccccttaaaaacgaacagatttcgttcgaagcagcttataatgcagtgtcagagaagaaaaggctaccaaggttcactctgaagaagttggtagagcaactgcatatccatgagcctgcgcagcatgtccaggccctgctgggctacaggtacccatccaccctagagctcttttctcggagtcatctccctgggccatgggactctagcagggctgggcaacggatgaagctccaaaggccagagacctgggagcgggagctgagcttacgtggaaacagagcttctgtgtgggaggaactcatagacaatgggaaactccccttcatggccatgctccggaacctgtgtaacctgctgcggactgggatcagtgcccaccaccatgaactcgttctccagagactccagcatgagaaatctgtgattcacagtcggcagtttccattcagattccttaatgctcacgactctctcgatagactcgaggctcagctcagaagtaaagcatcgcccttcccttccaatacaacattgatgaagcggataatgattagaaactcaaaaaaaatcaagagacctgccaacccgaggtacctgtgcaccctgacgcagcggcagcttcgggcggcaatggctatcccggtgatgtatgagcatctcaagcgggagaaactgaggctgcacaaggccagacagtggacctgtgaccttgagttgctggagcggtatcgccaggccctggaaacggccgtgaacatctctgtaaagcacaacctacccccgctgccaggccgaaccctcttggtctatctcacagatgcaaatgccaacagactttgtcccaagagtcacttgcaagggcctcccctgaactatgtgctgctgttgatcgggatgatgatggctcgggcggagcagacgacagtttggctgtgtgggacaggaactgtgaagacaccagtacttacagccgacgaaggtatcctgaagactgccatcaaacttcaggctcaagtccaggagttagaagaaaatgatgagtggcccctggaaacttttgagaagtacctgctatctctggctgtgcgaaggacccctattgacagggtcatcctgttcggccaaaggatggatacggagctgctgaatgtagccaaacagattatctggcagcatgtgaattccaagtgcctcttcgtcagtgtcctcctacggaaaatgcagtacatgtcaccaaatttgaatcccaatgatgtgacgctctcgggctgcactgacgggatcctgaagttcattgcggagcatggagcctctcgtcttctggaacatgtgggccaactagataagatattcaagatccctccacccccaggaaagacaaaggtctcacctctccggccgctggaggagaacaaccctggtcccttcgttcctatttcccagcatggatggcgcaacatccggcttttcatttcgtccactttccgagacatgcatggggaacgagacttgctgatgcgatctgttctgccagcgctgcaggcccgagcgttcccccaccgcatcagccttcacgccattgacctgcgctggggaatcacggaggaagagacccgcaggaacagacaactggaagtgtgccttggggaggtggagaactctcagctgttcgtggggatcctgggctcccgctatggctatactccccccagctatgatctgcctgaccacccccactttcactggacccagcgatacccttcggggcgctctgtaacagagatggaggtgatgcagttcctgaaccgtggccaacgctcggaaccctctgaccaagctctcatctacttccgagatcctggtttccttagctctgtgccagatgtctggaaacctgactttatttccgagtcagaagaggctgcacatcgggtctcagaactgaagagattcctacaggaacagaaagaggttacctgccgcaggtactcctgtgaatggggaggcgtagcagccggccggccctatactgggggcctggaggagtttggacagttggttctccaagatgtgtggagcgtgatccagaagcgttacctgcagcctggggcccagttggagcagccaggatccatctcagaagaggatttgatccaggccagctttcagcagctgaagagcccaccgagtcccgcacggccacgccttcttcaggataccgtgcaacagctgatgctgccccacgggaggctgagcctagtgattgggcaggcaggacagggaaagactgccttcctggcatcccttgtgtcggccctgaaggttcccgaccagcccaatgtggccccgttcgttttcttccacttttcagcagcccgccctgaccagtgtcttgctttcaacctcctcagacgcctctgtacccatctgcatcaaaaactgggagagccgagcgctctccccagcacttacagaggcctggtgtgggaactgcagcagaagctgctcctcaaatctgcccagtggctgcaaccaggccagactttggtccttattatcgacggggcagataagttggtggaccataatggacagctgatttcagactggatccccaagtctcttccgcggcgagtacacctggtgctgagtgtgtctagtgactcaggcctgggagagacccttcagcaaagtcagagtgcttatgtggtggccttggggtctttggtcccgtcttcaagggctcagcttgtgagagaagagctagcactgtatgggaaacggctggaggagtcaccttttaacaaccagatgcggctgctgctggcaaagcaggggtcaagcctgccactgtacctgcacctcgtcactgactacctgaggcttttcacactgtacgaacaggtgtctgagagacttcgaaccctgcccgccactctcccactgctgctgcagcacatcctgagcaccttggagcaagagcatggccataacgtccttcctcaagctttgactgcccttgaggtcacgcacagtggtctgactgtggaccagctgcatgcagtcctgagcacgtggttgactttgcccaaggagactaagagctgggaagaggcagtggctgccagtcacagtggaaacctctaccccttggctccatttgcctaccttgtccagagtctacgcagtttactaggcgagggccccgtggagcgccctggcgcccgtctctgcctctctgatgggcctctgaggacagcagttaaacgtcgctatgggaaaaggctggggctagagaagactgcgcatgtcctcattgcagctcacctctggaagatgtgtgaccctgatgcctcaggcaccttccgaagttgccctcccgaggctctgaaagatttaccttaccacctgctccagagcgggaaccatggtctccttgcaaagttccttaccaacctccatgtggtggctgcatatctggaagtgggtctagtcccggacctcttggaggcttacgagctctatgcttcttcaaagcctgaagtgaaccagaagctcccggaggcagatgttgctgtattccacaacttcctgaaacaacaggcttcactccttacccagtatcctttgctcctgctccagcaggcagctagccagcctgaagagtcacctgtttgctgccaggcccccctgctcacccagcggtggcacaaccagtgcatactgaaatggattaataaaccccagaccttgaagggtcagcaaagcttgtctctgccaatttcctcatccccaactgctgtggccttctctcctaatgggcaaagagcagctgtggggactgctggtgggacaatttacctgttgaacttgagaacctggcaggaggagaaggctctggtgagtggctgtgatgggatttcctctttcgcgttcctgtcagacactgctcttttccttaccaccttcgatgggctcctggagctttgggacctgcaacatggttgttgggtgttccagaccaaggcccaccagtaccaaatcactggctgctgcctgagcccagaccgccgcctgctggccaccgtgtgtttgggaggatacgtaaagctgtgggacacagtccagggccagctggctttccagtacacccatcccaagtctctaaactgcatcaccttccacccagaggggcaggtggtagccacaggcaactggtctggcatcgtgaccttcttccaggcagatggactcaaagtcaccaaggaactagggggcccaggaccctctgttcgtacgctggcattcagtgcacccgggaaggttgtggctctaggccggatagatgggacagtggagctgtgggcctggcaagagggcacacggctggcagccttccctgcacagtgtggcggtgtctccaccgttcttttcttgcatgctggaggccggttcctgacggctggggaagatggcaaggctcagttatggtcaggatttcttggccggcccaggggttgcctgggctctctttatctttctcctgcgctctctgtggctctcaacccagacggtgaccaggtggctgttgggtaccgaggagatggcattaaaatctacagaatttcttcaggtccccaggaggctcaatgccaagagctaaatgtggcggtgtctgcactggtctggctgagtcccagcgtcttggtgagtggtgcagaagatggctccctgcatggctggatgctcaggagaaactcccttcagtccctgtggctgtcatccgtgtgccagaagcctgtgctggggctggctgcctcccaggagttcttggcttctgcctcagaggacttcacggtgcgactgtggccaagacagctgctgacacagccacatgcagtagaagagttgccctgtgcggctgaactccggggacacgaggggccggtgtgctgctgtagcttcagcccggatggacgcatcttggccacagcgggcagggatcggaatctcctctgctgggacgtcaaggtagcccaagcccctctcctgattcacacgttctcgtcctgtcatcgagactggatcactggctgtacgtggaccaaagacaacatcctgatctcctgctctagtgatggctctgtgggactctggaacccagaggcaggacagcaacttggccagttcccaggtcaccagagtgccgtgagcgctgtggttgctgtggaggaacacattgtatctgtgagtcgggatgggaccttgaaagtgtgggaccgtcagggtgtggagctgaccagcatccctgcccattccggacccattagccagtgtgcggctgctctggaaccccgtccagctggacagcctggatcagagcttatggtggtgactgttggactggatggggccacaaagctgtggcatcccctgttggtgtgccaaatacataccctgcagggacacagtggtccagtcacagctgctgctgcttcagaggcctcaggcctcctgctgacctcagacaatagctctgtacgactctggcagatccctaaggaagcagatgatacctgcaaacctaggagttctgcggtcatcaccgctgtggcgtgggcaccagatggttctctggtggtgtctggaaatgaagctggggaactaacgctgtggcagaaagcgcaggctgtggctacggcacgggctccaggccgcgtcagtgacctgatctggtgctccgcaaatgcattctttgttctcagtgctaatgaaaatgtcagtgagtggcaagtggaactgaggaaaggttcaacatgcaccaatttcagactttatctgaagagagttctgcaggaggacttgggagtcttgacaggtatggccctggcgcctgacggccagtctctcattttgatgaaagaggatgtagaattgctacagatgaagcccgggtctactccatcttcgatctgcaggaggtatgcagtgcattcttctatactgtgcaccagcaaagactatggcctgttttacctgcagcagggaaactctggatctctttctatcttggagcaggaggagtcagggaagtttgaaaagaccctggacttcaatctgaacttaaataatcctaatgggtccccagtatcaatcactcaggctgaacctgagtctgggtcctcgcttttgtgtgctacctctgatgggatgctgtggaacttatctgagtgtaccccagaaggagagtgggtcgtagataacatctggcagaaaaaatcaagaaaccctaaaagtcgaactccggggacagattcgtccccaggcttattctgcatggatagctgggtagaacccacacatttaaaggcacggcagtgtaaaaagattcacttgggctctgtcacggccctccatgtgctgcccggattgctggtgactgcttcagaggacagagatgttaagctgtgggagagacccagtatgcagctgctcggcttgttccgatgtgaagggccggtgagctgtctggaaccttggatggagcccagctctcccctgcagcttgctgtgggagatgcacaaggaaacttgtattttctatcttgggaatga

SEQ ID NO: 14 - RNA, 143 nt, Rattus norvegicus
ggccagcuuuagcucagcgguuacuucgacgugcuccaguuugagcaggcuauguaacguggucgguucgagcaacacaaccagccgcuugccuaucuggugagugguugguucgagacccgcgggcgcucucuggcccuuuu

SEQ ID NO: 15 - protein, 12 aa, Artificial Sequence
  completely synthesized
MAGCGCPCGCGA

SEQ ID NO: 16 - protein, 905 aa, Artificial Sequence
  synthesized and Homo sapines
MAGCGCPCGCGAMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 17 - DNA, 2718 bp, Artificial Sequence
  synthesized and Homo sapines
atggcaggctgcggttgtccatgcggttgtggcgccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 18 - protein, 873 aa, Artificial Sequence
  synthesized and Rattus norvegicus
MAGCGCPCGCGAMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 19 - DNA, 2622 bp, Artificial Sequence
  synthesized and Rattus norvegicus
atggcaggctgcggttgtccatgcggttgtggcgccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 20 - protein, 31 aa, Artificial Sequence
  completely synthesized
MGSSHHHHHHSSGLVPRGSHMASMTGGQQPW

SEQ ID NO: 21 - DNA, 89 bp, Artificial Sequence
  completely synthesized
atgggcagcagccatcatcatcatcatcacagcagcggcctggtgccgcgcggcagccatatggctagcatgactggtggacagcaacc

SEQ ID NO: 22 - protein, 17 aa, Artificial Sequence
  completely synthesized
MKKKKKKKKKKKKKKKP

SEQ ID NO: 23 - DNA, 51 bp, Artificial Sequence
  completely synthesized
atgaagaagaagaagaagaagaagaagaagaagaagaagaagaagaagccc

SEQ ID NO: 24 - protein, 923 aa, Artificial Sequence
  synthesized and Homo sapiens
MGSSHHHHHHSSGLVPRGSHMASMTGGQQPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 25 - DNA, 2772 bp, Artificial Sequence
  synthesized and Homo sapiens
atgggcagcagccatcatcatcatcatcacagcagcggcctggtgccgcgcggcagccatatggctagcatgactggtggacagcaacccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 26 - protein, 910 aa, Artificial Sequence
  synthesized and Homo sapiens
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 27 - DNA, 2733 bp, Artificial Sequence
  synthesized and Homo sapiens
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 28 - protein, 892 aa, Artificial Sequence
  synthesized and Rattus norvegicus
MGSSHHHHHHSSGLVPRGSHMASMTGGQQPWMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 29 - DNA, 2679 bp, Artificial Sequence
  synthesized and Rattus norvegicus
atgggcagcagccatcatcatcatcatcacagcagcggcctggtgccgcgcggcagccatatggctagcatgactggtggacagcaaccatggatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 30 - protein, 878 aa, Artificial Sequence
  synthesized and Rattus norvegicus
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 31 - DNA, 2637 bp, Artificial Sequence
  synthesized and Rattus norvegicus
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 32 - protein, 96 aa, Saccharomyces cerevisiae
MKLLSSIEQACDICRLKKLKCSKEKPKCAKCLKNNWECRYSPKTKRSPLTRAHLTEVESRLERLEQLFLLIFPREDLDMILKMDSLQDIKALLTGL

SEQ ID NO: 33 - DNA, 288 bp, Saccharomyces cerevisiae
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggatta

SEQ ID NO: 34 - protein, 989 aa, Artificial Sequence
  Saccharomyces cerevisiae and Homo sapiens
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 35 - DNA, 2970 bp, Artificial Sequence
  Saccharomyces cerevisiae and Homo sapiens
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 36 - protein, 957 aa, Artificial Sequence
  Saccharomyces cerevisiae and Rattus norvegicus
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 37 - DNA, 2874 bp, Artificial Sequence
  Saccharomyces cerevisiae and Rattus norvegicus
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 38 - protein, 130 aa, Levivirus
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIY

SEQ ID NO: 39 - DNA, 393 bp, Levivirus
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctacccc

SEQ ID NO: 40 - protein, 1024 aa, Artificial Sequence
  Levivirus and Homo sapiens
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 41 - DNA, 3075 bp, Artificial Sequence
  Levivirus and Homo sapiens
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaa

SEQ ID NO: 42 - protein, 992 aa, Artificial Sequence
  Levivirus and Rattus norvegicus
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 43 - DNA, 2979 bp, Artificial Sequence
  Levivirus and Rattus norvegicus
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtga

SEQ ID NO: 44 - protein, 239 aa, Artificial Sequence
  completely synthesized
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKP

SEQ ID NO: 45 - DNA, 720 bp, Artificial Sequence
  completely synthesized
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagcccatg

SEQ ID NO: 46 - protein, 1132 aa, Artificial Sequence [sequence omitted]

SEQ ID NO: 47 - protein, 3399 aa, Artificial Sequence
  synthesized and Homo sapiens
ATGAGCAAGGGCGAGGAACTGTTCACTGGCGTGGTCCCAATTCTCGTGGAACTGGATGGCGATGTGAATGGGCACAAATTTTCTGTCAGCGGAGAGGGTGAAGGTGATGCCACATACGGAAAGCTCACCCTGAAATTCATCTGCACCACTGGAAAGCTCCCTGTGCCATGGCCAACACTGGTCACTACCTTCACCTATGGCGTGCAGTGCTTTTCCAGATACCCAGACCATATGAAGCAGCATGACTTTTTCAAGAGCGCCATGCCCGAGGGCTATGTGCAGGAGAGAACCATCTTTTTCAAAGATGACGGGAACTACAAGACCCGCGCTGAAGTCAAGTTCGAAGGTGACACCCTGGTGAATAGAATCGAGCTGAAGGGCATTGACTTTAAGGAGGATGGAAACATTCTCGGCCACAAGCTGGAATACAACTATAACTCCCACAATGTGTACATCATGGCCGACAAGCAAAAGAATGGCATCAAGGTCAACTTCAAGATCAGACACAACATTGAGGATGGATCCGTGCAGCTGGCCGACCATTATCAACAGAACACTCCAATCGGCGACGGCCCTGTGCTCCTCCCAGACAACCATTACCTGTCCACCCAGTCTGCCCTGTCTAAAGATCCCAACGAAAAGAGAGACCACATGGTCCTGCTGGAGTTTGTGACCGCTGCTGGGATCACACATGGCATGGACGAGCTGTACAAGCCCATGGCAACTGAAGAGTTCATCATCCGCATCCCCCCATACCACTATATCCATGTGCTGGACCAGAACAGCAACGTGTCCCGTGTGGAGGTCGGGCCAAAGACCTACATCCGGCAGGACAATGAGAGGGTACTGTTTGCCCCCATGCGCATGGTGACCGTCCCCCCACGTCACTACTGCACAGTGGCCAACCCTGTGTCTCGGGATGCCCAGGGCTTGGTGCTGTTTGATGTCACAGGGCAAGTTCGGCTTCGCCACGCTGACCTCGAGATCCGGCTGGCCCAGGACCCCTTCCCCCTGTACCCAGGGGAGGTGCTGGAAAAGGACATCACACCCCTGCAGGTGGTTCTGCCCAACACTGCCCTCCATCTAAAGGCGCTGCTTGATTTTGAGGATAAAGATGGAGACAAGGTGGTGGCAGGAGATGAGTGGCTTTTCGAGGGACCTGGCACGTACATCCCCCGGAAGGAAGTGGAGGTCGTGGAGATCATTCAGGCCACCATCATCAGGCAGAACCAGGCTCTGCGGCTCAGGGCCCGCAAGGAGTGCTGGGACCGGGACGGCAAGGAGAGGGTGACAGGGGAAGAATGGCTGGTCACCACAGTAGGGGCGTACCTCCCAGCGGTGTTTGAGGAGGTTCTGGATTTGGTGGACGCCGTCATCCTTACGGAAAAGACAGCCCTGCACCTCCGGGCTCGGCGGAACTTCCGGGACTTCAGGGGAGTGTCCCGCCGCACTGGGGAGGAGTGGCTGGTAACAGTGCAGGACACAGAGGCCCACGTGCCAGATGTCCACGAGGAGGTGCTGGGGGTTGTGCCCATCACCACCCTGGGCCCCCACAACTACTGCGTGATTCTCGACCCTGTCGGACCGGATGGCAAGAATCAGCTGGGGCAGAAGCGCGTGGTCAAGGGAGAGAAGTCTTTTTTCCTCCAGCCAGGAGAGCAGCTGGAACAAGGCATCCAGGATGTGTATGTGCTGTCGGAGCAGCAGGGGCTGCTGCTGAGGGCCCTGCAGCCCCTGGAGGAGGGGGAGGATGAGGAGAAGGTCTCACACCAGGCTGGGGACCACTGGCTCATCCGCGGACCCCTGGAGTATGTGCCATCTGCCAAAGTGGAGGTGGTGGAGGAGCGCCAGGCCATCCCTCTAGACGAGAACGAGGGCATCTATGTGCAGGATGTCAAGACCGGAAAGGTGCGCGCTGTGATTGGAAGCACCTACATGCTGACCCAGGACGAAGTCCTGTGGGAGAAAGAGCTGCCTCCCGGGGTGGAGGAGCTGCTGAACAAGGGGCAGGACCCTCTGGCAGACAGGGGTGAGAAGGACACAGCTAAGAGCCTCCAGCCCTTGGCGCCCCGGAACAAGACCCGTGTGGTCAGCTACCGCGTGCCCCACAACGCTGCGGTGCAGGTGTACGACTACCGAGAGAAGCGAGCCCGCGTGGTCTTCGGGCCTGAGCTGGTGTCGCTGGGTCCTGAGGAGCAGTTCACAGTGTTGTCCCTCTCAGCTGGGCGGCCCAAGCGTCCCCATGCCCGCCGTGCGCTCTGCCTGCTGCTGGGGCCTGACTTCTTCACAGACGTCATCACCATCGAAACGGCGGATCATGCCAGGCTGCAACTGCAGCTGGCCTACAACTGGCACTTTGAGGTGAATGACCGGAAGGACCCCCAAGAGACGGCCAAGCTCTTTTCAGTGCCAGACTTTGTAGGTGATGCCTGCAAAGCCATCGCATCCCGGGTGCGGGGGGCCGTGGCCTCTGTCACTTTCGATGACTTCCATAAGAACTCAGCCCGCATCATTCGCACTGCTGTCTTTGGCTTTGAGACCTCGGAAGCGAAGGGCCCCGATGGCATGGCCCTGCCCAGGCCCCGGGACCAGGCTGTCTTCCCCCAAAACGGGCTGGTGGTCAGCAGTGTGGACGTGCAGTCAGTGGAGCCTGTGGATCAGAGGACCCGGGACGCCCTGCAACGCAGCGTCCAGCTGGCCATCGAGATCACCACCAACTCCCAGGAAGCGGCGGCCAAGCATGAGGCTCAGAGACTGGAGCAGGAAGCCCGCGGCCGGCTTGAGCGGCAGAAGATCCTGGACCAGTCAGAAGCCGAGAAAGCTCGCAAGGAACTTTTGGAGCTGGAGGCTCTGAGCATGGCCGTGGAGAGCACCGGGACTGCCAAGGCGGAGGCCGAGTCCCGTGCGGAGGCAGCCCGGATTGAGGGAGAAGGGTCCGTGCTGCAGGCCAAGCTAAAAGCACAGGCCTTGGCCATTGAAACGGAGGCTGAGCTCCAGAGGGTCCAGAAGGTCCGAGAGCTGGAACTGGTCTATGCCCGGGCCCAGCTGGAGCTGGAGGTGAGCAAGGCTCAGCAGCTGGCTGAGGTGGAGGTGAAGAAGTTCAAGCAGATGACAGAGGCCATAGGCCCCAGCACCATCAGGGACCTTGCTGTGGCTGGGCCTGAGATGCAGGTAAAACTGCTCCAGTCCCTGGGCCTGAAATCAACCCTCATCACCGATGGCTCCACTCCCATCAACCTCTTCAACACAGCCTTTGGGCTGCTGGGGATGGGGCCCGAGGGTCAGCCCCTGGGCAGAAGGGTGGCCAGTGGGCCCAGCCCTGGGGAGGGGATATCCCCCCAGTCTGCTCAGGCCCCTCAAGCTCCTGGAGACAACCACGTGGTGCCTGTACTGCGCTAA

SEQ ID NO: 48 - protein, 1100 aa, Artificial Sequence
  synthesized and Rattus norvegicus
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQK

SEQ ID NO: 49 - protein, 3303 aa, Artificial Sequence
  synthesized and Rattus norvegicus
ATGAGCAAGGGCGAGGAACTGTTCACTGGCGTGGTCCCAATTCTCGTGGAACTGGATGGCGATGTGAATGGGCACAAATTTTCTGTCAGCGGAGAGGGTGAAGGTGATGCCACATACGGAAAGCTCACCCTGAAATTCATCTGCACCACTGGAAAGCTCCCTGTGCCATGGCCAACACTGGTCACTACCTTCACCTATGGCGTGCAGTGCTTTTCCAGATACCCAGACCATATGAAGCAGCATGACTTTTTCAAGAGCGCCATGCCCGAGGGCTATGTGCAGGAGAGAACCATCTTTTTCAAAGATGACGGGAACTACAAGACCCGCGCTGAAGTCAAGTTCGAAGGTGACACCCTGGTGAATAGAATCGAGCTGAAGGGCATTGACTTTAAGGAGGATGGAAACATTCTCGGCCACAAGCTGGAATACAACTATAACTCCCACAATGTGTACATCATGGCCGACAAGCAAAAGAATGGCATCAAGGTCAACTTCAAGATCAGACACAACATTGAGGATGGATCCGTGCAGCTGGCCGACCATTATCAACAGAACACTCCAATCGGCGACGGCCCTGTGCTCCTCCCAGACAACCATTACCTGTCCACCCAGTCTGCCCTGTCTAAAGATCCCAACGAAAAGAGAGACCACATGGTCCTGCTGGAGTTTGTGACCGCTGCTGGGATCACACATGGCATGGACGAGCTGTACAAGCCCATGGCAACTGAAGAGGCCATCATCCGCATCCCCCCATACCACTACATCCATGTGCTGGACCAGAACAGTAATGTGTCCCGTGTGGAGGTTGGACCAAAGACCTACATCCGGCAGGACAATGAGAGGGTACTGTTTGCCCCAGTTCGCATGGTGACCGTCCCCCCACGCCACTACTGCATAGTGGCCAACCCTGTGTCCCGGGACACCCAGAGTTCTGTGTTATTTGACATCACAGGACAAGTCCGACTCCGGCACGCTGACCAGGAGATCCGACTAGCCCAGGACCCCTTCCCCCTGTATCCAGGGGAGGTGCTGGAAAAGGACATCACCCCACTGCAGGTGGTTCTGCCCAACACAGCACTGCATCTTAAGGCGTTGCTGGACTTTGAGGATAAGAATGGAGACAAGGTCATGGCAGGAGACGAGTGGCTATTTGAGGGACCTGGCACCTACATCCCACAGAAGGAAGTGGAAGTCGTGGAGATCATTCAGGCCACAGTCATCAAACAGAACCAAGCACTGCGGCTAAGGGCCCGAAAGGAGTGCTTTGACCGGGAGGGCAAGGGGCGCGTGACAGGTGAGGAGTGGCTGGTCCGATCCGTGGGGGCTTACCTCCCAGCTGTCTTTGAAGAGGTGCTGGATCTGGTGGATGCTGTGATCCTTACAGAAAAGACTGCCCTGCACCTCCGGGCTCTGCAGAACTTCAGGGACCTTCGGGGAGTGCTCCACCGCACCGGGGAGGAATGGTTAGTGACAGTGCAGGACACAGAAGCCCATGTTCCAGATGTCTATGAGGAGGTGCTTGGGGTAGTACCCATCACCACCCTGGGACCTCGACACTACTGTGTCATTCTTGACCCAATGGGACCAGACGGCAAGAACCAGCTGGGACAAAAGCGTGTTGTCAAGGGAGAGAAGTCCTTTTTCCTCCAGCCAGGAGAGAGGCTGGAGCGAGGCATCCAGGATGTGTATGTGCTGTCAGAGCAGCAGGGGCTGCTACTGAAGGCACTGCAGCCCCTGGAGGAGGGAGAGAGCGAGGAGAAGGTCTCCCATCAGGCCGGAGACTGCTGGCTCATCCGTGGGCCCCTGGAGTATGTGCCATCTGCAAAAGTGGAGGTGGTGGAGGAGCGTCAGGCTATCCCTCTGGACCAAAATGAGGGCATCTATGTGCAGGATGTCAAGACGGGGAAGGTGCGGGCTGTGATTGGAAGCACCTACATGCTGACTCAGGATGAAGTCCTGTGGGAAAAGGAGCTGCCTTCTGGGGTGGAGGAGCTGCTGAACTTGGGGCATGACCCTCTGGCAGACAGGGGTCAGAAGGGCACAGCCAAGCCCCTTCAGCCCTCAGCTCCAAGGAACAAGACCCGAGTGGTCAGCTACCGTGTCCCGCACAATGCAGCGGTGCAGGTCTATGACTACAGAGCCAAGAGAGCCCGTGTGGTCTTTGGGCCCGAGCTAGTGACACTGGATCCTGAGGAGCAGTTCACAGTATTGTCCCTTTCTGCCGGGCGACCCAAGCGTCCTCATGCCCGCCGTGCACTCTGCCTACTGCTGGGACCTGATTTCTTTACTGATGTCATCACCATCGAAACTGCAGATCATGCCAGGTTGCAGCTGCAGCTTGCCTACAACTGGCACTTTGAACTGAAGAACCGGAATGACCCTGCAGAGGCAGCCAAGCTTTTCTCCGTGCCTGACTTCGTGGGTGACGCCTGCAAGGCCATTGCATCCCGAGTCCGGGGGGCTGTAGCCTCTGTCACCTTTGATGACTTCCATAAAAACTCAGCCCGGATCATTCGAATGGCTGTTTTTGGCTTTGAGATGTCTGAAGACACAGGTCCTGATGGCACACTCCTGCCCAAGGCTCGAGACCAGGCAGTCTTTCCCCAAAACGGGCTGGTAGTCAGCAGTGTGGATGTGCAGTCAGTGGAGCCCGTGGACCAGAGGACCCGGGATGCCCTTCAGCGCAGCGTTCAGCTGGCCATCGAAATTACCACCAACTCCCAGGAGGCAGCAGCCAAGCACGAGGCTCAGAGACTGGAACAGGAAGCCCGTGGTCGGCTTGAGAGGCAGAAGATCTTGGACCAGTCAGAAGCTGAAAAAGCCCGCAAGGAACTCTTGGAGCTTGAGGCTATGAGCATGGCTGTGGAGAGCACGGGTAATGCCAAAGCAGAGGCTGAGTCCCGTGCAGAGGCAGCGAGGATCGAAGGAGAAGGCTCTGTGCTGCAGGCCAAGCTCAAGGCACAGGCGCTAGCCATTGAGACGGAGGCTGAGTTGGAGCGAGTAAAGAAAGTACGAGAGATGGAACTGATCTATGCCCGGGCCCAGTTGGAGCTGGAGGTGAGCAAGGCGCAGCAGCTTGCCAATGTGGAGGCAAAGAAGTTCAAGGAGATGACAGAGGCACTGGGCCCCGGCACCATCAGGGACCTGGCTGTGGCCGGGCCAGAGATGCAGGTGAAACTTCTCCAGTCCCTGGGCCTGAAATCCACTCTCATCACCGATGGCTCGTCTCCCATCAACCTCTTCAGCACAGCCTTCGGGTTGCTGGGGCTGGGGTCTGATGGTCAGCCGCCAGCACAGAAGTGA

SEQ ID NO: 50 - protein, 267 aa, Artificial Sequence
  synthesized and Homo sapiens
MAGCGCPCGCGAGIPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 51 - DNA, 804 bp, Artificial Sequence
  synthesized and Homo sapiens
atggcaggctgcggttgtccatgcggttgtggcgccggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 52 - protein, 1736 aa, Artificial Sequence
  synthesized and Homo sapiens
MAGCGCPCGCGAMVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFPLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQITLHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLTPTTRAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 53 - DNA, 5211 bp, Artificial Sequence
  synthesized and Homo sapiens
atggcaggctgcggttgtccatgcggttgtggcgccatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 54 - protein, 351 aa, Artificial Sequence
  Saccaromyces cerevisiae and Homo sapiens
MKLLSSIEQACDICRLKKLKCSKEKPKCAKCLKNNWECRYSPKTKRSPLTRAHLTEVESRLERLEQLFLLIFPREDLDMILKMDSLQDIKALLTGLGIPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 55 - DNA, 1056 bp, Artificial Sequence
  Saccaromyces cerevisiae and Homo sapiens
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 56 - protein, 1820 aa, Artificial Sequence
  Saccaromyces cerevisiae and Homo sapiens
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFPLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQITLHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLTPTTRAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 57 - DNA, 5463 bp, Artificial Sequence
  Saccaromyces cerevisiae and Homo sapiens
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 58 - protein, 491 aa, Artificial Sequence
  synthesized and Homo sapiens
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 59 - DNA, 1476 bp, Artificial Sequence
  synthesized and Homo sapiens
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 60 - protein, 1961 aa, Artificial Sequence [sequence omitted]

SEQ ID NO: 61 - DNA, 5889 bp, Artificial Sequence
  synthesized and Homo sapiens
atgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 62 - protein, 385 aa, Artificial Sequence
  Levivirus and Homo sapiens
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYGIPANLRLPMASALPEALCSQSRTTPVDLCLLEESVGSLEGSRCPVFAFQSSDTESDELSEVLQDSCFLQIKCDTKDDSIPCFLELKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 63 - DNA, 1158 bp, Artificial Sequence
  Levivirus and Homo sapiens
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctacggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 64 - protein, 1854 aa, Artificial Sequence [sequence omitted]

SEQ ID NO: 65 - DNA, 5565 bp, Artificial Sequence
  Levivirus and Homo sapiens
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctacatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 66 - protein, 550 aa, Photinus pyralis
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 67 - DNA, 1654 bp, Photinus pyralis
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtggtaa

SEQ ID NO: 68 - protein, 805 aa, Artificial Sequence [sequence omitted]

SEQ ID NO: 69 - DNA, 2418 bp, Artificial Sequence
  Photinus pyralis and Homo sapiens
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgggaattcctgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 70 - protein, 2274 aa, Artificial Sequence [sequence omitted]

SEQ ID NO: 71 - DNA, 6825 bp, Artificial Sequence
  Photinus pyralis and Homo sapiens
atggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggactttcccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcctctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtatgtgattgaattcattttcagtgatacacatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccagtgagagcgaagtgattatttgtcttgactgctccagttccatggagggtgtgacattcttgcaagccaagcaaatcaccttgcatgcgctgtccttggtgggtgagaagcagaaagtaaatattatccagttcggcacaggttacaaggagctattttcgtatcctaagcatatcacaagcaataccacggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaagcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcgccttttcctgatattccaaaagtttctgaacttattgccaaagaagatgtagacttcctgccctacatgagctggcagggggagccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatggcttaggtgtactaccagctttcacatcaaatttggaacgtggaggtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaagtgtgatacaaaagatgacagtatcccgtgctttctggaattaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaa

SEQ ID NO: 72 - protein, 16 aa, Drosophila melanogaster
RQIKIWFQNARMKWKK

SEQ ID NO: 73 - DNA, 51 bp, Drosophila melanogaster
cgacagatcaagatctggtttcagaacgcacggatgaagtggaagaagtga

SEQ ID NO: 74 - protein, 909 aa, Artificial Sequence
  Homo sapiens and Drosophila melanogaster
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 75 - DNA, 2730 bp, Artificial Sequence
  Homo sapiens and Drosophila melanogaster
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 76 - protein, 877 aa, Artificial Sequence
  Rattus norvegicus and Drosophila melanogaster
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 77 - DNA, 2634 bp, Artificial Sequence
  Rattus norvegicus and Drosophila melanogaster
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 78 - protein, 11 aa, Human immunodeficiency virus type 1
YGRKKRRQRRR

SEQ ID NO: 79 - DNA, 33 bp, Human immunodeficiency virus type 1
tacgggcggaagaagcggcgacagaggcgacgg

SEQ ID NO: 80 - protein, 904 aa, Artificial Sequence
  Homo sapiens and Human immunodeficiency virus type 1
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 81 - DNA, 2715 bp, Artificial Sequence
  Homo sapiens and Human immunodeficiency virus type 1
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 82 - protein, 872 aa, Artificial Sequence
  Rattus norvegicus and Human immunodeficiency virus type 1
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 83 - DNA, 2619 bp, Artificial Sequence
  Rattus norvegicus and Human immunodeficiency virus type 1
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 84 - protein, 179 aa, Artificial Sequence
  completely synthesized
DIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGR

SEQ ID NO: 85 - DNA, 747 bp, Artificial Sequence
  completely synthesized
gacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcg

SEQ ID NO: 86 - protein, 1072 aa, Artificial Sequence
  synthesized and Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGR

SEQ ID NO: 87 - DNA, 3429 bp, Artificial Sequence
  synthesized and Homo sapiens
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 88 - protein, 1040 aa, Artificial Sequence
  synthesized and Rattus norvegicus
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGR

SEQ ID NO: 89 - DNA, 3333 bp, Artificial Sequence
  synthesized and Rattus norvegicus
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 90 - protein, 56 aa, Homo sapiens
MGNSDSECPLSHDGYCLHDGVCMYIEALDKYACNCVVGYIGERCQYRDLKWWELRA

SEQ ID NO: 91 - DNA, 171 bp, Homo sapiens
atgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 92 - protein, 949 aa, Artificial Sequence
  Synthesized from two Homo sapiens sequences
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 93 - DNA, 2850 bp, Artificial Sequence
  Synthesized from two Homo sapiens sequences
atggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 94 - protein, 917 aa, Artificial Sequence
  Rattus norvegicus and Homo sapiens
MATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 95 - DNA, 2754 bp, Artificial Sequence
  Rattus norvegicus and Homo sapiens
atggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 96 - protein, 1005 aa, Artificial Sequence
  Saccaromyces cerevisiae and Homo sapiens and Drosophila melanogaster
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 97 - DNA, 3018 bp, Artificial Sequence
  Saccaromyces cerevisiae and Homo sapiens and Drosophila melanogaster
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 98 - protein, 973 aa, Artificial Sequence
  Saccaromyces cerevisiae and Rattus norvegicus and Drosophila melanogaster
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 99 - DNA, 2922 bp, Artificial Sequence
  Saccaromyces cerevisiae and Rattus norvegicus and Drosophila melanogaster
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 100 - protein, 1238 aa, Artificial Sequence
  synthesized and Saccaromyces cerevisiae and Homo sapiens
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 101 - DNA, 3717 bp, Artificial Sequence
  synthesized and Saccaromyces cerevisiae and Homo sapiens
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 102 - protein, 1206 aa, Artificial Sequence
  synthesized and Saccaromyces cerevisiae and Rattus norvegicus
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 103 - DNA, 3621 bp, Artificial Sequence
  synthesized and Saccaromyces cerevisiae and Rattus norvegicus
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 104 - protein, 1045 aa, Artificial Sequence
  Saccaromyces cerevisiae and two Homo sapiens sequences
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 105 - DNA, 3138 bp, Artificial Sequence
  Saccaromyces cerevisiae and two Homo sapiens sequences
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 106 - protein, 1013 aa, Artificial Sequence
  Saccaromyces cerevisiae and Rattus norvegicus and Homo sapiens
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 107 - DNA, 3042 bp, Artificial Sequence
  Saccaromyces cerevisiae and Rattus norvegicus and Homo sapiens
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 108 - protein, 1000 aa, Artificial Sequence
  Saccaromyces cerevisiae and Homo sapiens and Human immunodeficiency virus type 1
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 109 - DNA, 3003 bp, Artificial Sequence
  Saccaromyces cerevisiae and Homo sapiens and Human immunodeficiency virus type 1
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 110 - protein, 968 aa, Artificial Sequence
  Saccaromyces cerevisiae and Rattus norvegicus and Human immunodeficiency virus type 1
MKLLSSIEQACDICRLKKLKCSKEKPKCAKCLKNNWECRYSPKTKRSPLTRAHLTEVESRLERLEQLFLLIFPREDLDMILKMDSLQDIKALLTGLMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 111 - DNA, 2907 bp, Artificial Sequence
  Saccaromyces cerevisiae and Rattus norvegicus and Human immunodeficiency virus type 1
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattaatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 112 - protein, 1040 aa, Artificial Sequence
  Levivirus and Homo sapiens and Drosophila melanogaster
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 113 - DNA, 3123 bp, Artificial Sequence
  Levivirus and Homo sapiens and Drosophila melanogaster
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 114 - protein, 1008 aa, Artificial Sequence
  Levivirus and Rattus norvegicus and Drosophila melanogaster
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 115 - DNA, 3027 bp, Artificial Sequence
  Levivirus and Rattus norvegicus and Drosophila melanogaster
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 116 - protein, 1273 aa, Artificial Sequence
  Levivirus and Homo sapiens and synthesized
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 117 - DNA, 3822 bp, Artificial Sequence
  Levivirus and Homo sapiens and synthesized
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 118 - protein, 1241 aa, Artificial Sequence
  Levivirus and Rattus norvegicus and synthesized
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 119 - DNA, 3726 bp, Artificial Sequence
  Levivirus and Rattus norvegicus and synthesized
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 120 - protein, 1080 aa, Artificial Sequence
  Levivirus and two Homo sapiens sequences
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 121 - DNA, 3243 bp, Artificial Sequence
  Levivirus and two Homo sapiens sequences
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 122 - protein, 1048 aa, Artificial Sequence
  Levivirus and Rattus norvegicus and Homo sapiens
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 123 - DNA, 3147 bp, Artificial Sequence
  Levivirus and Rattus norvegicus and Homo sapiens
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 124 - protein, 1035 aa, Artificial Sequence
  Levivirus and Homo sapiens and Human immunodeficiency virus type 1
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 125 - DNA, 3108 bp, Artificial Sequence
  Levivirus and Homo sapiens and Human immunodeficiency virus type 1
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 126 - protein, 1003 aa, Artificial Sequence
  Levivirus and Rattus norvegicus and Human immunodeficiency virus type 1
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 127 - DNA, 3012 bp, Artificial Sequence
  Levivirus and Rattus norvegicus and Human immunodeficiency virus type 1
atggcttctaactttactcagttcgttctcgtcgacaatggcggaactggcgacgtgactgtcgccccaagcaacttcgctaacggggtcgctgaatggatcagctctaactcgcgttcacaggcttacaaagtaacctgtagcgttcgtcagagctctgcgcagaatcgcaaatacaccatcaaagtcgaggtgcctaaagtggcaacccagactgttggtggtgtagagcttcctgtagccgcatggcgttcgtacttaaatatggaactaaccattccaattttcgctacgaattccgactgcgagcttattgttaaggcaatgcaaggtctcctaaaagatggaaacccgattccctcagcaatcgcagcaaactccggcatctaccccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

SEQ ID NO: 128 - protein, 926 aa, Artificial Sequence
  synthesized and Homo sapiens and Drosophila melanogaster
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRRQIKIWFQNARMKWKK

SEQ ID NO: 129 - DNA, 2781 bp, Artificial Sequence
  synthesized and Homo sapiens and Drosophila melanogaster
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgccgacagatcaagatctggtttcagaacgcacggatgaagtggaagaagtga

SEQ ID NO: 130 - protein, 894 aa, Artificial Sequence
  synthesized and Rattus norvegicus and Drosophila melanogaster
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKRQIKIWFQNARMKWKK

SEQ ID NO: 131 - DNA, 2685 bp, Artificial Sequence
  synthesized and Rattus norvegicus and Drosophila melanogaster
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagcgacagatcaagatctggtttcagaacgcacggatgaagtggaagaagtga

SEQ ID NO: 132 - protein, 1159 aa, Artificial Sequence
  synthesized and Homo sapiens
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 133 - DNA, 3480 bp, Artificial Sequence
  synthesized and Homo sapiens
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcgacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 134 - protein, 1127 aa, Artificial Sequence
  synthesized and Rattus norvegicus
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKDIVLTQSPASLAVSLGQRATMSCRAGESVDIFGVGFLHWYQQKPGQPPKLLIYRASNLESGIPVRFSGTGSRTDFTLIIDPVEADDVATYYCQQTNEDPYTFGGGTKLEIKGSTSGGGSGGGSGGGGSSEVQLQQSGAELVEPGASVKLSCTASGFNIKDTYMHWVKQRPEQGLEWIGRIDPANGNSKYVPKFQGKATITADTSSNTAYLQLTSLTSEDTAVYYCAPFGYYVSDYAMAYWGQGTSVTVS

SEQ ID NO: 135 - DNA, 3384 bp, Artificial Sequence
  synthesized and Rattus norvegicus
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaaggacattgtgctgacccaatctccagcttctttggctgtgtctcttgggcagagggccaccatgtcctgcagagccggtgaaagtgttgatatttttggcgttgggtttttgcactggtaccagcagaaaccaggacagccacccaaactcctcatctatcgtgcatccaacctagaatctgggatccctgtcaggttcagtggcactgggtctaggacagacttcaccctcatcattgatcctgtggaggctgatgatgttgccacctattactgtcagcaaactaatgaggatccgtacacgttcggaggggggaccaagctggaaataaaaggcagtactagcggcggtggctccgggggcggttccggtgggggcggcagcagcgaggttcagctacaacagtctggggcagagcttgtggagccaggggcctcagtcaagttgtcctgcacagcttctggcttcaacattaaagacacctatatgcactgggtgaagcagaggcctgaacagggcctggaatggattggaaggattgatcctgcgaatggtaatagtaaatatgtcccgaagttccagggcaaggccactataacagcagacacatcttccaacacagcctacctgcagctcaccagcctgacatctgaggacactgccgtctattattgtgctccgtttggttactacgtgtctgactatgctatggcctactggggtcaaggaacctcagtcaccgtctcgtga

SEQ ID NO: 136 - protein, 966 aa, Artificial Sequence
  synthesized and two Homo sapiens sequences
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRMGNSDSECPLSHDGYCLHDGVCMYIEALDKYACNCVVGYIGERCQYRDLKWWELRA

SEQ ID NO: 137 - DNA, 2901 bp, Artificial Sequence
  synthesized and two Homo sapiens sequences
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgcatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 138 - protein, 934 aa, Artificial Sequence
  synthesized and Rattus norvegicus and Homo sapiens
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKMGNSDSECPLSHDGYCLHDGVCMYIEALDKYACNCVVGYIGERCQYRDLKWWELRA

SEQ ID NO: 139 - DNA, 2805 bp, Artificial Sequence
  synthesized and Rattus norvegicus and Homo sapiens
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagatgggtaactctgactccgaatgcccgctgtctcacgacggttattgcctgcatgatggtgtttgtatgtatatcgaagctctggacaaatatgcttgcaactgtgttgttggttacatcggtgagcgttgccagtatcgcgacctgaaatggtgggaactgcgtgcatga

SEQ ID NO: 140 - protein, 921 aa, Artificial Sequence
  synthesized and Homo sapiens and Human immunodeficiency virus type 1
MKKKKKKKKKKKKKKKPMATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLRYGRKKRRQRRR

SEQ ID NO: 141 - DNA, 2766 bp, Artificial Sequence
  synthesized and Homo sapiens and Human immunodeficiency virus type 1
atgaagaagaagaagaagaagaagaagaagaagaagaagaagaagaagcccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctacgggcggaagaagcggcgacagaggcgacggtga

SEQ ID NO: 142 - protein, 889 aa, Artificial Sequence
  synthesized and Rattus norvegicus and Human immunodeficiency virus type 1
MKKKKKKKKKKKKKKKPMATEEAIIRIPPYHYIHVLDQNSNVSRVEVGPKTYIRQDNERVLFAPVRMVTVPPRHYCIVANPVSRDTQSSVLFDITGQVRLRHADQEIRLAQDPFPLYPGEVLEKDITPLQVVLPNTALHLKALLDFEDKNGDKVMAGDEWLFEGPGTYIPQKEVEVVEIIQATVIKQNQALRLRARKECFDREGKGRVTGEEWLVRSVGAYLPAVFEEVLDLVDAVILTEKTALHLRALQNFRDLRGVLHRTGEEWLVTVQDTEAHVPDVYEEVLGVVPITTLGPRHYCVILDPMGPDGKNQLGQKRVVKGEKSFFLQPGERLERGIQDVYVLSEQQGLLLKALQPLEEGESEEKVSHQAGDCWLIRGPLEYVPSAKVEVVEERQAIPLDQNEGIYVQDVKTGKVRAVIGSTYMLTQDEVLWEKELPSGVEELLNLGHDPLADRGQKGTAKPLQPSAPRNKTRVVSYRVPHNAAVQVYDYRAKRARVVFGPELVTLDPEEQFTVLSLSAGRPKRPHARRALCLLLGPDFFTDVITIETADHARLQLQLAYNWHFELKNRNDPAEAAKLFSVPDFVGDACKAIASRVRGAVASVTFDDFHKNSARIIRMAVFGFEMSEDTGPDGTLLPKARDQAVFPQNGLVVSSVDVQSVEPVDQRTRDALQRSVQLAIEITTNSQEAAAKHEAQRLEQEARGRLERQKILDQSEAEKARKELLELEAMSMAVESTGNAKAEAESRAEAARIEGEGSVLQAKLKAQALAIETEAELERVKKVREMELIYARAQLELEVSKAQQLANVEAKKFKEMTEALGPGTIRDLAVAGPEMQVKLLQSLGLKSTLITDGSSPINLFSTAFGLLGLGSDGQPPAQKYGRKKRRQRRR

SEQ ID NO: 143 - DNA, 2670 bp, Artificial Sequence
  synthesized and Rattus norvegicus and Human immunodeficiency virus type 1
atgaagaagaagaagaagaagaagaagaagaagaagaagaagaagaagcccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatcaacctcttcagcacagccttcgggttgctggggctggggtctgatggtcagccgccagcacagaagtacgggcggaagaagcggcgacagaggcgacggtga

What is claimed is:

1. A method of delivering one or more than one substance, comprising:
   a) providing vault-like particles comprising a polypeptide, the polypeptide being linked to MVP, VPARP, a portion of VPARP, or a modified MVP, VPARP, or portion of VPARP; and
   b) administering the vault-like particles,
   wherein the substance or more than one substance comprises the polypeptide, an agent that binds preferentially to the polypeptide, or a combination thereof.

2. The method of claim 1, where the one or more than one substance is selected from the group consisting of an enzyme, a pharmaceutical agent, a plasmid, a polynucleotide, a polypeptide, a sensor and a combination of the preceding.

3. The method of claim 1, where the one or more than one substance is adenosine deaminase.

4. The method of claim 1, where the substance or more than one substance is a sensor selected from the group consisting of a chemical sensor, a fluorescent sensor, an ionic sensor, a microorganism sensor, an optical sensor, and a pH sensor.

* * * * *